United States Patent 9,976,180 (METHODS FOR DETECTING A GENETIC VARIATION IN SUBJECTS WITH PARKINSONISM) - sequence listing, part 31

SEQ ID NO: 457 - DNA, 529704 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggcaggactcatcctgggagtgctgtgctgtgctctccctccgctgcgaaatattggagatttttttgcataattcattccctgccctctccatttcgtccctctcatgccccccaccctttacccctttccgtgccagtgccagaacactacttaccccagagttcttttctctgcaggttcctagaccaggtgcaactcttgcctgcaagtccctgcctccctcctcccgaaaagggggaacaccgcctttccaagtccgggtgccagcagcggctgctgccaactgcgccttcgcccaactccaggaggatccgggactattggaaacccgggctttagaggaacgggcttcccttcttgtctttcttttattctgcttttctttagggaagctctagtgctttggaggcttttgctgggctccaggatactttccgccaacgacactcagcagcttccactgaaggagatttccccaccaaacccgcgcgcgcacacacacacacacccagcgcgcggctctccagggccccaggggaaagtaggggcggcgcgagcaccacccacccacccaggccgaggccaggggcagccagtccgcagaaggtctcgtggggaggcgggctgtctataacctaggaaagacttgcacccggttgcagtgtggatgcaggggaattgaagaaaaccctgtgctcagaactgcttgcctaagagggctgggaacgaaaggggaaagacaaaatctcaacagatttgtctgcttccatcgctgcagtggtggtttgcgaaagctcaaacctacctctttggggttattgaagaagaggagggagcgtagagggaatccctgggaagatccaggatttctcggcgcgcttgtcccgattgggaactgt

SEQ ID NO: 458 - DNA, 528459 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagag

SEQ ID NO: 459 - DNA, 6834 bp, Homo sapiens
ttctacagcatctttttattgtctttaccattactttaatgcattttaaaatttatctacattaattgggaacaaagaaaaatagacatttctttgtttttcataaataactaatcttcatatttgataaaaatctcaaatgattattttaccttcccacaaatataatacatacaaaatttttctgaagtaaggtcaacaaattaagtatcttgagactaacataaccacatacaactgctgtttctactgactcccaggaacgaagcagaaacaaaaactcatcaagctgctctgggtttccttttgtaagtgttacagattcagaactgtaatcatgtatcatctgccagtaataacatatggattcaaattgattgtctacaaataaagtatcgctggctctagtgtaacttctggatttaacataacagtgactacagcatgggataggcactatacatatatggaaatcataaacagtatcgaatgccctggacttcaactactgactcggtatgtgcctcatttggctcagtaataaattcacctgcaccaaacccgtatcaaaagtcaccaaatctctcatatatatatataatatatattatgtatatatacaacccacaaaacatacatactatacatagtttgtaacaacatgaagtcatactgtcttaaaatgatgcactcacagacagacactatcctggctgaaataaatcctattgtcatcaggctgctagcttttgagagtcttgactcaggttagctacttatattctgcctactcttcacccttctttaacgtcttggcagttctttcagaaccaccctccgcaatccagacagatttgtttcccaggatcacttgattggactttggaaacaagaaagagcatgcagagggagcaggcaattcttagccactgtccctcacacctgcctatacgtgtgatgtgctctgtcctgttggccacatttagtgttagaaagcagttattcaaagctctgtccctcctaccccccttgggctttctgtagagcacaaaagtgaaagaagcttctttggctggggtagcagttcattaaaatatacaactacatttcctagctctggggttcccattctgtactggagagtgcaggtcacggatgctgttattaaggtttggtgtgtgatccatgaggttttctcctggcagccggtgtcaggattagcgcagctccagcccaggaggcaacagcctaatgaataccaactttgaaacagtgctgtcggcacgttatttaagcttgtacatgcccacaattacacacaacacacacatgggccttggtcactggcaatggtcatgagaaaatatgagaaaggtttgcaaggaaaaccaataaggcaccaagaaaaattatttccagtcaattttaccatttcaaaatgtgagaaggaaaatcatagaaattaaaaagatttcctaaaatctggtcagctaattcactgagaggtcccattagttcctttagacaacctacctgaatggaatccttaccccctaagctatgaagtgaggcattgcttaaaatcaaactgaaagggacagccctgaagctgtacacataagagactccaatgggccctaagtcctccccagctccacaaagctggctgtgaagaagttgctgaactactccataaccttttattttacagttgctttcatgagcatgacttgtttccataatcacatgcaaattgggggaagtaactatatggatggaaacagggggtggctgtaagtagatccagtttctctcccctggggtggctgatctcagtaagacttagggatgcaggtgggcttttatctttgtctctcttaggggatgagggaagagagggacagcagaggtgagaacagagacaaagaagtgcttctgaaagttggtctggaattagaccccaaagatcctgactaatattgccccccacttgggcttagcgtcctttgttttaactggcttatttttaaagtaaattagttgttcagcatgttgctaaaacaaaacaaaaaaaaattctaaaaatgaattaaatcactttcatccacttcatcccacaacttttggatacactgtgcatcatttccagatttctccacaaagaaggagggacaacccaaatgaggcacaatgactgaaggcagcagagcagtctgtctactttctgggaagacatatgaaatgagggaaaaggtcaaggtgatcagaaaaggttctctcatttgaaaaacaggagaggaattggcattcagtcaagggatctatttcaagattctaggaagaggcttcttcctagaagaataaatagaggaataaaataggcacaaagttctgtagctatttgtacgaggttttgtagaatccactgaaattttaattcagaggataaattgggtaagagcagtgcattttaataaatgtgaagtttttgagagtccttacaactttaatactaggtttcttcccaccagtaaagtgtttaaattccccctgggaactatgcatttgtctatttaacatccatgaagtaaaaattgtcctaggcttaaattttacttttccaactttggtataagtgaattacaaatgcctacactcaagttgttttcctagacaggattttctcaaatgttaattgctctggccattttagcttcctaaatttagtccccaatcctggtcattggtattttgctggctgaggcactgtcaccccccttccccagtaatggccccacactcttcatgaatgaatgcttaaacagattaggaaagcaaacagaattttctaatagcaaagaaacctctgtgtgtatgttcatcaatataagcgttcataatgaatgaaggaatagttaaacagattagtaaagcaaaccaaattctctaattgcaaagtgtgtgtgtgtgtgatcatcaatatacaggctttctcagaagaggaagaaaactatagaggtagcactatactgatctatattttaaaaggttgtgcaagcatgttatgcatctcttttgttttcagagacggcagagagcaacgtcttgctgctcttggaatatctggctataaactagtccaaagtccaggaacacttattttcccttatttgggccaatgtttgttcacaggtagccagcctccctcccccagttcaagcacttcattcaagggtgggtgtggtttctaatcacagctctccaggagaggaggaataagaaaagcaaaaaggctgtttaacatgataaagggggaggggggaggggggagggggtggagcaaataagtgttggaaatttacttattagaagtatatccatttcagtccttacatttaaaaaggagccccctttagcaactgtcgctaagtattgtccagagggagtgggtttatacttttaccaaaattataacacaagttccttaaaaaaaaaaaaaaaaaaaaaaaaaggggatcactgaagcttaagaaccacccactacctctcaggcacaaagctgccatctcaccagcctaaaattcaagctccaccaatcaccatcgcttaggctctcactactgcaaatatttatgccagatcctctataatgctacctctaacttattcaagacacaacgatggtgctgttaggagtgagaattattacaagcactacagaaaagaaactgaacctccctctataaacaaagctaaggctgaacacaaaaccgctaagcactccctaaccttgtcactttggggaggccctgagctcattatgctcccctcctaggtatgacctggggctataaactgcagctcaccttaaagaatcatggacactttaagcagtggaaggagaagctggctgaaaaagcacacccaacaacttcccagtcacagcaaccgaaacgttcactgttcacatttttttttaaagacacacgtataggaaatatattttcccaattgagaccacacagttcaaagaaacctgaaccaagtggaacttcattacaacgccaaccttaggattgtaaagcccccaaagcaaaggtaaattgttgccaaaatgcaacaaagttacaaattaagaaaaatacatataaattaaaaagagggttcccataaagaaggcagtaagaaacgcaaaatagaatacacgtgagctgggccccttggagaagacctgggacaggttcttcctcgaaaacgcccctcttccctctctccaagtcgccgcgggagggggcaacagcaccatgaaggtaaacggaagtgaccttggcaaaactaccaaacaaaacgcccccctcccctcagctctccggccgagtccctcggcggcagcctcctacacgtgcgacagggacacctgcttgtggtaggtggcggcggggcccggcggcccggtcctgcctgtgagcgcggcgctcgcctcggggtagtcccctgcggccatggcgcccccgctcttgtggccgcgccgcgggcggcagcagcagcggctggtgaaacgccgccacgactccaccgtcttgcccgaccagatccagacgcccgacgtgatgcccaccaccaggcacatgaagtacttgagcatgagcacccagtactcgggcttggcgcgcggctggccggtgtcgtggcccgggcaggcgcaggtgagcgccgcctcccagctctcgcggtagtgctgctcgtacaggtagcaggccaccacaatgctggcggggaccgtgtagagcagcgtgaagatgccgatgcggatcatgagcttctccagcttgtccgtcttggtgccgccctgcttgatgacgctgcggatgcggaagagcgacacgaagcccgccagcaggaagagcgtgcccaccagcaggtagagcaccagcgggcccagcacgaagccgcgcagcgagttcaggttctggttgcccacgtagcagatgccggccactgggtccccgtccacggagctcagcgccagtgccgtgatggacttgacgctggggatgagccacgcagccaggtggaagtactgcgcgtagcccgcgatggcctcgttgccccacttcatgccggcggccaggaaccaggtgagcgacaggatgacccaccagatggagctggccatgccgaagaagtagaccaggaggaagacgatggtgcacagtgcagggcccgtggtctcgtagtggatgtggttgtgctcgcggctgcaggccacgctggcatggcccacgaccagacgcaccaggaagcccagcgacacgcacaggtagcaggctgacaggaagatgatggggcgctcaggatagcggaagcgttccatgtcgatgaggaaggtggccactgtggtggacgtggagatgaagcacagcaccgaccacaggcctatccagaaggtggcgaacgtgcgctcgtcggcactgaaggacggctggtagcagggtaccgcgcagttgggcacctggcccgtccgcaccttgttgtagagcgggtgtgactccttcagaatgggcacgaagggctcgcgacacttgcacacgaacgggcccccagcggggcattcgccccccgaggccggcgcccctggcgggcctggaagggtgggcttggctgggaaaggcctggggggcgccgtggtggcctcgctgcggttgtaatccatgcagaggacctcggcgtcgcggcccagcaccgggaggcggtcgcagctcatgcgctcgggccaggcgaagccgtactggcgcatcagcggcgagcagccggccttggcgcgctcgcacaccgagcggcagggcggcagcggcttgtggtagtcgggcagacagatgggcgtgtacatagagcataggaagaagcgcaggtccggcgagcattggatctccaccagcggccagaactggtgcacctccaggcccgcctcgtcctgcgtgtcgtggttgaactggttgggcatgtgcgtcaggttgtagccgatgccgcggcacatgggcaccgtgatttcctggcacaccggggccttggacgcggcggccgcccggcccaccagctgcgctaggagcagcagcaacagcgagggcggcgcggatgggtcaggccgagccatcgccccctccctcccctcgcctccagcagcccgcgagggacgcacacaggcagaggaatccgggccggggcttctccctccggcgtctcgtgtgtggcgccggggctggcaacctgttggttgctttttcctttaaagaaaaccgtccaaagataaactgcttcgggaaggcgctgcctccgctggcagcgctccgctcctcgccggatagggctggggagagacggttagggctcggattccagggaaaggactctttaaaaaagaagggggagaagaaagattgcaaccactccctgttggagaggcgtcaacagttcggtccccgcgagctgtctccaaatctcttaagttaacccctttcctttcctccccgctccgcctcctgtaaccaaactaccgactcccccaccctctctttccaagctgggcccttcaggcagtgcccggagaccagaaccctcagcttcccggaaaagggcacaggaaacgggagaagaacagggagaaagggaaggttctcacctccacggatcccgccgagaagagcagacagtccccagccagcctgggtcctccgtccctgggtcactccgctgagaagcgcgactcagagccgggctggcgcccggaaagtttagcgacaggctgggtacccgtggcagcggcacatggcagca

SEQ ID NO: 460 - DNA, 17217 bp, Homo sapiens
ttgggtaagaaaattttatttcacaatgtaaagggttatgtgagacccaactgtattctatctgaagcattagaagccaactgtagtaaatgcatcttacttatattcgatgctggccagaggagctattctgcttcctttagaagttatgctttttattgtggcttgtggtaaccatgtaacatgcaagagcaatggttttcaggaagaaactattatgccttacagcttttgccccaaatcacaagaaaacttgaactatgtcattaaacatcccataaatgctgacagaagataaaggatatttattatatgaaattgtctacgccctcagactacaattcctgaatagttagatggtgaccatgttcatccttctggattaatgaaaacttggaaagcagtcaaagctgcctgggccctggctggctggctctcccttcagcctgctccccccaggagccctgagcatctccttctgccattgcctgtacagcttggaggcttttcacatcttggagagcttgatgtcataagtgaccatgttcaagttgtcccaggcaaagagcttcttctccagggggttgtagtcaatcatgctgctgtacttatagcggttcttgaatgggatggtcagggtcttgctgatacctgtgcctgtgtcataagcaaagttgacggtagcatctgctgaggtgtagctgctgacggtgtacaaggtgccacagatgatgaaggcattggcgactgactgcttacggatgtttgtctcccaggtttgttcgagttccagattctctgggttcagtttggagaggacaatggcacctttggcctcatcggtgctgtaaatgacccagaggcctgcttcatccacagccaagtcaatgtccgtgtagccaccccaagaatacgggaactgtccgtggtagccagctccagggatttccttctcagccttcactgtctcggtattcagctcatatcttatgacagttctggactcagcgccctggaaatagaggctccccgagtacaccacagcacccgtgctttccagtggcctaggcagtatgtgaaccttagaagggtagccctgcataaactggctgatgaggtcatactcaaaaacctggcggacatccgtgccaactgtgtcgattctccacgtggtctcctgggtgtaggggtaggtgggcttggggtctcgcatccacacaccatacttgccagtaattgtttctgctgttctcagcgtgagaggctctcctacccaaactagttctccacatcctggtaaattcagaaaagaaaacgaagcaccacttaatccataatctttccaaacacagacaatgatcatgcggaagcttggcagagccagtagatgtgacagccctggagacaaatcgtctgggtttaaagctaggctctaccacccgctggctgtgtgactttcagtaagttacttagctctctacgcctcagttatcgcatttgtaaaaggggatactaatagtgttttgggtagtagggctgttgtaaattttaaatgtaattatatatgttaagtgcttggtatagagtaaatatatggtaaatgctatatgatcaatctgtgtttcatgttattgacaattattgctatcactgaggggcatgcatgggagtgggagctataaaatatttaaagtacaattcactcagtatcagttgtaaggatgaaagttgcacagagggcttcaactgcatttgtaatattctacttaagctgggcagggacccatgggtgttcattgtattacttattgtgactttcatgcctggtttatttcattactataaggtaggagagagaaaaatcaactcataagaataatctccatacaacaaagtttttcaagccctgatgagtcacatatttcatacatcattttaatataataaacatgaaaataattattttttgagacagggtcttgcactgttacctaggctggagtgcagtggtgcaatcacagtgcactgcagcctcgaccttccaggctcaagcacccctcccatctcagcctcctgagttgctgggactacaggtgcctgctaccacacctggctaatttggtttagaaaataattttttaaatgtagtgaagagacggttgaaaatttagagttaccagaatcacaacagatgtctgtattttttttttttttgagacagagtctcactctgtcgcccaggctggagggcagtggtgtgatctcggctcactgcaacctctgcctcctgggttcaagcaattttcctgcctcagcctcccaagtagctgggattacagatgactgccaccatgcctggctaatttttgtatttttagtagagacagtgtttcaccatgttggccaggctggtcttgaactcctgacctcaagtgatccgcccgcctcagcctcccaaagtgctgggattacaggcatgagccaccatgcctggtccagatttctctacttttaatggcaccttcggttccctcatagaaggtagaaacactttgctgctcatatcttagagaaccgtgttttaaatatttcataacccctacttgcatgcatgcccttcagtgctagtaatcattgtcaataacatggatagtcaaagtttctggaaatcacagtattagtcataaagttggactttcagggaacactttggagagagccaaactgtacttttcctaagtggccaaagttcagaaaacatactgttagtaacagattgtggctgagatggtgcttggtgtatacctgtccctaaaataaagatatgaaggcgctactgaaaaatgtaacttctcaagtatatctaattctacatgacaatcaagtggatgaaatcaacacatctctcatcttgccctgtgcagcccagcccagcctcccaagtgtgggtgataggatagagggctttgttagggaaaggctgactcctgcagacctgctctgacaagggaacagagagagagagagagttctgttcctcttctcctcccctccctctgctcccagggaagttaatttcccccttgggtgggcatttaccctatactgattctctgaacacagcactagacatgaataaagaccacgtgggcacaaaagggaagaaacttaacttcataccggtgtctccctctccactcctgagatagccagatgggctctccttcaaaattcgggaagcaggaacttcagttagctcggacttcagttcctggaaggccaaagtgtccaaattccacgtagaaactgcattaaaagaaagagacaaaattttactgtaagaaaaaatggcccaaggattgactatgttgaggatgacatttaaataggctgccggccaggcgtggtggctcatgcctgtaatcccagcactttgggaggccgaggcaggcggatcacctgaggtcaggagttcgagaccagcctggccaacatggtgaaaccctgtctttgctaaaaacacaaaagaattagctggatgtggtggcaggtgcctataatcccagcttcttgggagactgaggcaggagaattgcttgaaccaaggagggggagattgctgtgagccgagactacactattgtactccagcttgggcaacaagaaagaaactctgtctgaaaactaactaactaaataaataggctcccaaagatatggtgtttgagatttgattttagataaggactggggatgggttgggggtcagagaagggaagataaaacatgattggactgtgctgataacagttgggcctgagtgatggctacattggagttcattgtagtctctctacttttgtgaatatttgaacaattccataattaaaaacctcataaataataaattgcagggcaatgtgcctaccttagagtagggtattcaaaatcaaataatattttaattccactagaagggctggtttgtgaataggtgagtcgtaatttcaggaatatggagacagtcctcagcatcttcttagatgtctgaatttcaataattaaaaattcatgaaaaattagctgggcatggtggtaagcatctgcagtcctaggtacttgggaggctgatgtgggaggattgcttgagcccagaagttcaaggctgcagtgagctatgatcctgccactgcactccagcttgggtaacagagcaaggcccggtctcaaggtctcaaaaaaaaaaaaaaagagaccgggcacagtggctcacactgaaatcccagcactttgggaggccgaggcaggcggatcacttaaggccaggagttcaagactagcctggccagcgtggtgaaattccatctttactagaaatacaagaattagcagggtgtggtggcacatgcctgtagttccagatactcaggaggttgaggatcacttgaacccaggaggcaaaggttgcagggagccgggattgtgcaactgtactccagtctgggcaacagagcaagactctgtctcaagaaaaaaaaaaaaaaaaaaaaaaaaaaagaagtgtggctcatgtctgtaatcccagcactttgggaggccaagacaggaggagtacttgagcccaggtgttcaagaccagcttgggcaacatagggagactcctgttaaaaaaaaaaaaaagataaaagtttactgcatgacttaaggttttttcccttgttatatgcaaatattcttgtaagaagtaacatattaagctttatactttcagtagaaatattctgtctgattcctttctgagaccagttttgcataatggagagggagtgtgtgcagagttcctataggagtttggggtgggggtggtgagccatacagaagggaagcgggtgggcagcattggttagacagtaagtgatcatggtgtgctacatgtctctactcttgcttaggattatgatcttacagcagtcttgaatacaaggatgaggcaatagtcacaaggaacaggcttggctattttaaaatgcagtttggccaggcccagtggctcatacctgtaatcccagcactttgggaagccaaggtagacagatcactggagcccaggagttcaagacaaacctgggcaacatggtgaaatcccatctctacaaaaactacaaaaagttagcctgggtggtgatgtgtacctgcagtcccagctacttgggaggctgaggtgggaggatcacttgagaccgggaggtcaaggctgtggtgagcagtgatcgtacctctgcactccagccctggcgtagagtgagaccctgtcctcccctccaacctcccaaaaaacccatcacatacacataaaaacaaataaaatgcaggtttgatgattattcaggtgtggcaaggccaacatcccaggaggcaattgtcactgaaaagcaagttaaagcaaaattatggagacagtaaaaagatcagcagttgttgggtgaggaagggatgactaggtgaggcacagacgatttttagggcaatgaatactgtgtatgatactataatggtggacacatgtcactatgcatttgtctaaacccatagaaggcgcaacaccaaaaatgaaccctaatttaaaccgtggaccttgggtgttgtgcgtgctgatgcaggttcatcagttgtaacaactgctgtggcgggagatgatgataatcggggaggctgtgcatgtgtgggggccagtagtatctgggaactgtttgtacttttctctcaatttggctgtgaacataaaactgctctaaaaaaaaattatctttacaagttgttgtactcacagagcccaagaggaagggggcacactaagcccaggaggccacctggggaagcaccagggttgctccagaagagggcaccaggggaaaatgtgggaaagcgcctttattctttccatgggaaggaaagaaaggggaggcagggtaagcaggtttaggattggggagtttgaataatttcagcaggatctggggtcacaggagttatctctaattgtctggtaccaggccctgggtgattaggtcagggggacagtggccttgagtttgagccagatggaggtggtcacagggtgtgggctctggattggttggtttgcatatgaaagctgtcctcccaggtgagtcctttgctaaccgtaggaactggctacccctgggaggggcagtccctctcacgtttgcaaggcccagacagcaaagcatcagaataaaaagacatgcttaatacactgggcttttctcttgctgaacctctgagtcacttctctgccctttgagcaacttgttccccgctcaggattctcaggtgttcaggacagtgggaggaaagtcagtgcatcccctgaggccggagcgcctacacagccgagagggtcgggaagacatgttctgcctttgatcatttgtttgctcagctctcctaaatttagatttcaggcagagaggatcaccacagaagtcttaatcctctggttctaccacatttcatcaaagccacacattattttacattttcacatctccagagtcagggtaccttgtttgagttgctggggttcagcttcaacaaattatagtactggaaaaaatttctccctggaaggaggtgaagaaaacattcagctagctctcaggtgcaggctgggccagacagccatgctgcccacagtgagccagctcagtagctgctgcagctgcctgcccctgatcccagctacccttctctcctctccacccctgcctctgtgtggctgcagttgttagcctccctaaaagtgttaatgccctggaggtgggtgggtcctccatccctgggatatccctcagtctagagtgcaccatgtaagtagttaaaacccataagctggccaggcgcagtggctcatgcctgtaaacccagcactttgggaggccgaggtggcaggattgcatgaggccaagagtttgggaccaggctgggcaacatagcgagaccccatctttacaaaaaattaaagagttagctgggtgtggtggtgcagtctgtggtctcagctactcgggaggctgaggcaggaagatgactcttgagtccaagagggcaaggctgcagtgagccatgatcatgccactgcactccagtctgggtgacagagtgagaccctgtcttaaaaaaaaaaaaaattaaaaaaagaaagactcataagccaaaatgtatatgtaactgaggacatcctcaatgtgcattccaaactccaggggcaattgggagtaccccccgggacatggcaggccttcattattcctagcctcaaatccacagagctatttatccatccttttagtcacatcattggagcacctattgagtgcaaggctgtgctaggtgctcaagaaaaaaaggtgtctaagacacaagtttgtctaataggctagtctatgtttaaaaaaaaaaaaaaaaagacacaatcagtccatgcccttaaggaaatcataatctggcaaagtcctcatacccgagaaggaaaatgggtttattccaggctgctgcggaaaccagtttcttggacaatctgaatggctcctggagagtcctggaaacttttatttcattccctgcgtctccttctccctatctgaggttgtgcaggggtgaggaaacccctttgttcttcattctaaaggttgcattggcctaggagggtatccagggcagggactgattcactaggtcaaatggagtttccttagatcgacctgagaccagtaccagctgcttcccttctccccctgtgcaggcaacacacacctccggcagggacttggtgctgcctatgggggagagggacagggtgcccgaggttccctgttcttctgtgctgccagggagaggtaagagagagtgaccgccttcctgtacacaggtggcagaaccatctgtaaccttcctctctgatgctgcctcgccgattgccatgccttctctcttaggcccagaacacacacccaggctgttaggagcagcccaccgctccctggccctgccagcctcctgcaatgtgcagaggctcattcgatgtggcaaagtcttgccaggacaatttttcaaaatcagggcattaagcaagttccttgaattgagctggtttcctttcatctgtacctcttcttggatcactgcagactctgcctcaggacaactcaaatttcttttctttcattgtctcaactctcagaatataagagttgctgggcatggtggctcacgcctgtaattccagcactttgggaggctgaggtgggtggatcatgaggtcaggagttcgagaccagcctgaccaacatgctgaaaccctgtctctactaaaaatacaaaaattagccgggcatagtggcacatgcctgtaatctcagcaactagggaggctaagtcaggagaatcgtttgaacctgggaggcaaaggttgcagtgagctgagattgtgccattggactccagcctgggtgacagagagactctgtctcaaaaaaaaaaaaaaaaaaaaaaaaaggagttggtttcaggcaatgtgaggagagagaaatactgcatgccatctgtacacaaagtctggaggactgccccaaccttgtccctacacttcagctatgccatccacagttgccatgggagggtcccttaataaatgtgtcaatactaaaatttctctggaatgtttcaaaatcactaacatttcattctgaatgtggaagaaaaccaaaaagagattatgaaaatattaagggctatattgtgacagatcgttaacatttttagggcttttttttttaggtttttaaaaaaatattaaattcaggcgagccatccctcccctgcatctggcccctttacacatacaaaatgatgtattttatgctggttatttaatttaacaacttaccgagaaaagatgtatactaagaaaagtaggggtacctacctaccagtcagtggggagaaaattaagaaagaaatgccccttttgctatagagggaaggaagaaagtgaaacccaaaaaagtcaggcattttcacagatgacttccttgtggatagctaaagtatgtactggctttgcaactctaaaaaacagctttttttttttttttttttgtgaaacaagatggtttgtcggcatttatagctctttgcccatttcaagtaatttttatgtaatttttaaatgtgatctggtgccttcaaagtttcagagaaatagagaaaggctttaggactgcagatagcgcctgataaagttgaactatcgctactacttattaagtgtctcttatgagccagtactgtgctgggtgcttgctactcactactttcaaataatggtcctgaaagtgaacattaatatccccttttgcaaatgaggaaaccgaggttcagagaggttaagtaacatgcccaaggtcacacagctaagtggtatcgctgggacttgaacccatgtcttccgaggccatggcagctgcgaactcttccatcctgtgctgaggaggtgtgtcagttataaacgcattgcctctcagagctgaatgcaccctcccatgtatgctgtctgaagaacaagagctttgaagtgagcgcgatgttgaactatctcagtagagggcgctggagggacatcgtgggaggaaaaaggtctgcagttttcctgtcctgcgtccataggtggtatgactgtgaggacatttgttggagtcctaccccagccacggacccagagcgaagttcttctgtgacctcacagccacagcctggccataacctttccacagccctcccaacaaggaacccagagtccctgcacacggacctcagtgctctggaggcctcctgcctgtgcctgccctgactcccaccatgcccttgccacacgttgcaggttgccctcctcacctgcactgggaggcggcctattgcagctgcagaccagctgaggcctgcacaccttagccaccttctctgcaagctgatgtgctgaacctcaccttccccttccaagcttgtccggcaccctccctcagccctaggtgcctatggagttcacgtctatctatagttgctctttcatcacggttagtaattctttaaagtaaacttccccagcttaacccactgtgtgatttctatctcccgactggacccagatggctactggaggcttcagaagagtctcaaagatgctgctcagcactttgtggggtgacccactcctggggctgagctcaggtcccagtgggttgccttgtaaactctcagctcctgggctgtgcactcaatcctcttatcagttcttctaccctcactggcaaagaagaggcagcaaaagtgcctggctggtgccaagttccctgctgaatcccaccatggcccttacggctctgagcaaggagcccttcagattgtgccttgcaggaaccactccttatgtgcattagctggaataaacatgaactgcaataaaacaaaatgtcagggaatggcttccaggatgacggcaaggccagttcccatttggcaggggcgatggttaagttatgagcctgctggcttcttctaggtcatgtcagccaggagcatctggcaatggtcagactccaggaatagagccatctggcatgcgggtggaagcccagaatagaggatgcaaaacccaaaggcagggaaacaatctcgtaaaggggcctggacctaagccggaagtcatagctcctagttcagctctgccatgtcccagctgtgtgactttgggtaaatgactccacctctctgagccccagtatgctgagctgaattgtttggatgattacataagtaactataaatgaaatggccctcaataaagatgtgtcaacactaaaatttctctggaatgttttaaaatcactaacatttcattgtgaatgtggaggaaaaccaaaaagagactgtgaaaatattaagggctgtactgtgtcagatagttagcatttttggggcttttattttttaaggtttttttttttgtttttttttttttgagacagggtctcgctctgtcacccaggctggagtacagtggcatgatctcagctcattgcaacctctgcctcctgggttcaagtgattcttctgcctcagcctcctgagtagctgggactacaggtgcctgccaccacgcctggctaatttttgtatttttagtagagacagggttttaccatattggccaggctggtcacgaactcctgacctcgtgatccgcctgcctcagcctcccaaagtgctgggattacaggcgtgagccaccacgcccagctgttttttttctaggttttttaaaatgttaaattcagtccttctgtggtttaaaggttcatgtctattacaaaattctggaaatgttctgtgttctctgccgtcgcttctttatagacttggcattttagagacctcaacccggaaactgaatttattaactcgtttgcctgtagacataggcattgtaataattttcatagatattttctatcactggaaagttcagtccatattacataaatgaaaggaatgaagtaaaacaagctatgcctaattatctacaggttgtcagaaacatcttaggaaagtgaagactagctaatagactattgtcctgagtactgctctaacttgtactgtctctagaatcaacgcatgttattaaaatgttatgcacatgttgacatattgattattgaatgatgctttaaaacaatagtggaaccctggccaggtgcagtggctcatgcctgtaatcccagcactttgggaggctgaggcgggtggatcacgaggtcgggagttcaagaccagcctggccaacatggtgaaaccccatctccactaaaaatacaaaaattagccgggcatggtggcgtgtgcctgtaatcccagctacttgggaggctgaggcaggagaattgcttgaatccaggaggtggaggttgcagtgagccaagaccacgccactgcactccagcctggtgatagagcgagactccatcttcaaaaaacaaaacaaaacaaaaaacaaaaacaatagtggaactcaagtaaaataagcctttctagttatattttattcactgggtggccactgctcagcgctgcactgggtgcttccctgtgtgactgctaatttgcatgatgactcccatgagggattctcatccccatcctattctaggtgaggaaagggaatctgcagcacttgtgttgaacacctcaggtttctcccctcaccctcccctcacatcctgcccacttttttgcagtcattgctgaggcaacctgcctcttgcagttatcacctgcggggacctcgcctcagccaccgtggcccagcttctctgactttctgcatagaaagtctacaagaacaggccaggcgccgtggctcatgcctgtaatcccagcactttgggaggtcaagatgggtggatacttgaggtcaggagttcaagaccagcctggccaacatggtgaaaccctgtctgtactggaaaaaaaaaaaaatacaaaagttagctgggcgtggtagtgtgcacctgtaatcccagctactcgggaggctgaggcaggagaattgcttgaacccaggaggcggaggttgcagtgagccaagatcgtgccaccgcactccagcctgggggacagagaaagactccatcttaaaaaaaaaaaaaaaatcagtctgcaagaacaaacctcgtccccacatctgagtatcagggaagcgcaatatactccatgggatagcccttggccaagagggtatcagatccatgcgtaaacctcccctcttctgttgcagtctacacagcccctctgaagggcttgatgggattgagcctccattgcccactgtggtgactagctggagaaggcccccattttgtggctttcctgccttccctgtctcactttcccctgtctcaacttctcttctctaggatcatggtccatataaaccaactgcacacaagccctcttccaggctctgttcaacaggagaccagtccaaagcaggggctaaataacaaacaaagcagtccttctcttgtgacagtaataaccaactctaatttatcttctagtaaattatatatgtattttattatatatataataaatttatatatataattatatatatttatatgtattatatgtaatatatatatttttttgagatggagtctcgctctgtcacccaggctggagtgcagtagcgtgatcttggctcactgcaacgtctgcctcccaggttcaagcgattctcctgcctcagcctctggagtaactggattacaggtgcccgccaccacacccggctaatttttgtatttttagtagagacaagttttcaccacagtggccaggctggtcttaaactcctgacctcaagtgatctgtccacctcggcctcccaaagtgctaaggttacaggtgtgagccaccacacttggctaattgtattttttttctacttttcaaaaactattatatatacataaaatttatatatgtatatatatgaaaatttatataagcccagagaagaaaaagttatatataactttgtagtaatagttatgtagtaaaatatgtcatattatgtgtatgtataaacaagtgatttctatgattataaggaatttttttctacataacaactattaatacatgatcaagaaagtggtggtaacaatttgagttgcaggtggaatacagaaaggctgccttctcaggccttacctttgtccactcagcctcactaagcttctctacccaaaccttcacacctagttcttgccactcctgcaaaaaagcatacctagacttatattccagcctccagaatgcccccttttccctagatctggccttgaaacagatcttttgttccaagcattcctgtacctttctgtcttttacctttagggtctataaaccagaggtcagctgaaggtcttgaaagtcaatgaacctcatggccatgtacagggagggctcacacctgtaatcccagtgctttggaaggccgaggtcggcagatcacctgaggtcaggagttcgagactagcctgaccaacatggtgaaaccctgtctctactaaaaatacaaaattagccgggcatggtggcacatgcctataatcccagctactcaggaggctgaggtaggagaattgcttgaacccgggaggcagaggtttcagtgagccaagatcgtgccattacactctagcctgggcaacaagagtgaaactctgtctcaaaaaaaaagaaagaaagtcactgaacttcagaggaagaggccagaattcgagctttgccactaactggtagatggccatggacaagctgaataacctctctgggcctcagtttccatatctgcaaaaatcagccagcggtaccggatgctcattaggtccctttccagttccacattcttgtactaatgtaatttcctgctcatgaaaaacatctactactagaaaagaacttccatgtttggtgttcaatataatgggatgttgcccttatttcaaaagtggagtagctggaaagatcaagaaaaaatataaaattaggaaacacatctaataaatccccaaagacttgttaaatgaccacaaaagaaaaaaaaaggcaaaacattgccactatttttgtacacacacacacacaccacccacacccacatacacacatgcaggagtttttattgagaatgtaacttcattcaacagtctgaaataagtaatgcctcatcacacttctggtaatgatgattctttcaattgtctccacagattcaagtctcaagctctaccactgaccagctgggcaaccttggccccttagcatcttaggacttcactttccttggttgtaaaattcagaattggatctcttctaattctaacaatctaaacattttttaaaaatcctttacatcttataggtatttcatgtgaaccccacaaaaattattcacagcaggaattttctttgttatgttatggacaagaaatgaagatgcagagggttcaataacttgcccaaggtcatccccaggctctggctcttaggttttctaaccccatagctatgaagagcttgcctttcacgtagaaggctctttttaggaaatattttctcataattttaaagcttttcaagcctatagaaaaactgaaagaatagtacaataagctccccatatacttagattcaccagtttgtaattcaccagttattaatattttgccacagttgttttacctttctttctctcattatctatatatttgcagtctttcttcaaccatttgagagcaaattgcagacatcctgacgcctcaccctgggtacttaagcatgtatctccatagaacaaagattttatccttcgcaaccacagtatcattatctcaccaagaaactgaacattaatacagtaacataataatgagcagtcaaattgcctcagttatcccaaacctgttcctcatagcctttttcccccttggatgaagacaccaatcaagactcatgcactacatttggttaacacatttctttagtctctttaatatagaacaagcccttccccaccccttttttctttcttccttggcactgacatctttgaccagtccaaactaattgtccaacaactggatttgcttgcttatttcctcatgattagaacacttcctcaacagggaatatttgggagcccactttcacaaaaagtgacacaaataccatcttcccagctaataagaagacctcccccaacacctcacccccgcaccccccccacacacacacagactcacctttaggcaagaagggaccaggatgaacagaagagcctctcagaaaaagccatctcaagaatttgtctgatgacttaaaagcagaggttctcagattggactgagtaagaaaactttcagaacaacatattaagaaaactgacagagaggtgccatctctttattttgccagggaagaacatttaaaaataaacaaaaacttaccacttattatcatttcccaaatctattgtaatttcataaataaaggtcattttaacatcaaaaggtacaaataacaatctgagcaaaggttcaaaaaaggatagtttttcaaaagggacaattgacaactttctactgctcatatgcagacacatctcacccggtccttttatttctccttttgctatggactgtgaaaactgacatggaggggcacaagaactctgaaccactaatctaaatgaagctctcaggagctaaattactagtaatacttgaaggtgatcgctgtgctttccttaattcatctgtcttgtgctagctgtgcagtctctaggagaaagggcaggcagggaggcctggagcgcctgtagcaggtcactacgagccatatcacctgctgaactcagagtccccccactctgcattcttaccttctctggagcctggtggcacagcccgagcagtgtctcgggtctggggacactggccccttctcagccttgctacctcctggctgctgctttccaacctcctggccagattctcattttcttgccttagtcgcttcttctcttcctccagaactgacttgtctcggaggaggttgctgtaggcagtctccaactctctggtttgggtttccagctggtcccgctcccgcctcagggtgcccagctccctctgcagcccctcctgggtctcctggggcctggcagcctggtccaaggtcaattggtggaggaggctctccagggagctgagtcgagctttggtggcctccaggtctaagcgttgggtgctgctgtctctctgtaagttatggatgactgacatggcctggctctgctctgggcagctggattcattgggactggccacactgaaggtatactggcatcggccactctggtcattggccttcctgagctgagctgtcctggcccccacatcccacaccaggcaggccagaagcagcagctggacagctggcatctcaggcccaaagctgcagcaacgtgcacagaagaacctcattgcagaggcttggtgaggcttc

SEQ ID NO: 461 - DNA, 16211 bp, Homo sapiens
attagggcattttaaaaattttatttcttggctcttagtttatcatgtagaaaaatcctccatgaaatattgctataattacaatacagccttgggaaggaagctcaggggctgtgaatggaatcctaatctgcctgaaatcttgatccagacagaccaaatctcttccctcagagacttcaaacactgcagtcttcaaactacatccaagaaaatcttcatccaagtaaaatttcccccaaatatcctttctctaccccaccctatcctgtagttagggaaaaacccaggactgaatcaatatcctcagacctttccgttcaagtgggatcagaacctttagtaaccacatcggcaacagaggttgaaaccacaccttcaagaaatagtattcacatgtgacctggtcctagacttccagtaagaatgactcagagtctccccgctctgaaatactgaagtatttattggtcttagggtattctcgggaaggtgacagtgaggggttcttcaaaggagaacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagc

SEQ ID NO: 462 - DNA, 16211 bp, Homo sapiens; identical to SEQ ID NO: 461

SEQ ID NO: 463 - DNA, 8585 bp, Homo sapiens
gaaatactgaagtatttattggtcttagggtattctcgggaaggtgacagtgaggggttcttcaaaggagaacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagc

SEQ ID NO: 464 - DNA, 73907 bp, Homo sapiens
tacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtct

SEQ ID NO: 465 - DNA, 2285 bp, Homo sapiens
tcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtct

SEQ ID NO: 466 - DNA, 36133 bp, Homo sapiens
ctctttctgacagtgcagggattctgaagctgtctgcttgagttactgtgctctcttccaaggctgtaggagttctggagctgctggctggagaggagggtggacgaagctctctctagaaagacatcctgagaggacttggcaggtgagcactgtttcaaggaatgggctgatggggtcataatccatgataacctcaccaatcttttagagtcacagctggtgagaagagcaaaaatcctcacagaaaagcagaaattcctagggaccatgaaagacagtacctgccaagtcttaggaggaaacactgggcagaggaaaaggcacctttatggcagcaacagggagagacgagggcagctggaaaaaggtggtaacagggggctggtagttgggtggtggtcagagaaggatgaatctcagaggaggtgagaccagaagaatgaagaagagcttattatggaaaaagagagggaccagcaggtacaaaggcaatgtgtagttctgctcaggagctggtacagtaatcttcaattcttattccatagaaaaaaaggagacagaaatgtcagacactgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgtgagttaatactgaataaactgtatatatatatacagttgtgtatatatatatacacacatacatatgttaatacttagtaaactcatatatatgcttatatatatgagtttataagtattacttatacatatgagtttataaaatatatatattccattagttctgtttctctagagaaccctgactaatacagattttggtaccagaagtggttctagaggaaaagaatattaaggatggagttcttttgttggttttggggtttctggagttggtgccttaatatgattagaccccaaaatactaaggactctacttctaatagtatggagaagactgatagcccttggtgtgaactgtttaaagagttatacaaaataaatgcatttgacactcctgattcattgctcatgagaggcaaggagtttagtgaccctatacatcatacctttgaccatatgtggagaaccaaggaacataatgaagctggttggttgctcctaagttcagtggataaagtgatgaaagaaaatgatgaactcggggattctatctcaccgcttcagaagcagatactgagcctcaaatctgccaagattgccctgagtgagagtctaatctcctgtagagaaagaactgaaattgtggaaaaatagacataagctcttatcatgttagtggctgacctgcaatgaaaggtgcatgcacagcctcaccatgcacagcctcaccaagtatctactgttaaagtgagggcattgattgttttgcaggaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtccccaattaacactcttatagtttcttatgcctatctttactttaatctcttaatcctgttatcttcataagctcagaatgtaattcacctcaggactactattgcacaaatggattgtaaaacatgtgtgtttgaacaatatgaaatcagtatacctggaaaaagaacagaatatcagtgattttcagggaacaatggaagataactataaggtctgactgcctgcggggtcgggcagaatagagccatatttttcttcttgcagaaagcctatagaaggatgtgcaagtaggagaaatattgctgaattcttttcccagcatggaagaaccctggggaaggaatgcattcctgggggtaggtctatagatggcctctctgggagtgtttgtcttatgcggttgagataaggactgaaatacgccctggtgtcctgcagtaccctcaggcttactaggattgggaaattccagccgggtaaattctagtcagagtggttctctgttctcaaaccctgtttcctgtgaagatgtttatcaagacaatgtgtgcacagcaggacatagaccctcatcagtaattctaattttgcctttgccttgtgatctttactgccctttgaagcatgtgatccttgtgacctactccctgttcatacaccctctcctcttttaaaatccctaataaaaacttgctggttttgctgctcggggtcaccatcatagtcctaccactatgtgatgacagccccagaggcccagctgtaaaatttctgtctttgtactcgttctctttatttctcagaccggccgacacttaggaaaaatagaaagaacctatgttcaaatattgtgggctggttcccctgatagattggaaaagaatgagaccctgcaacttggaatggggaggtatgggaggacactggtgaagctggggtcactgactttgtaaactccaatgaactttttttgccagaagaaacaacttcctccccacccagtagtggcagcattccctccctaacccatgctgccatcagcctttccacctttgtctgaggaggtaaactctgtgctgcctgaggcaatagtgatggcctcccctgaggcagttgccaagcaagataatgagaaataacaatcagtacagtttggctctcagaaagccacatccctaggaaaagggaaagagtactacatcaggggaacatcccatgggaaaaaagaatctgaacaatagccttgagccccagatcttccctctaacatagcctacccaaatgagaaggaaccaggaaaacgattctgggaatatgacaaaacaaggctgtttaacacctccccccaaaaatcacactagctcaccagcaatggatccaaaccaagaagaaactcctaatttacctgagaaagtattcagaagggcaattattaagctaatcaaagaggcaccagaaaagctgaagtccaatttaaggaaaaaaaaaaatacaagttatgaggggagaaatcttcagtgaaatagatagcatacataaaacaatcataactttaggaaataaagaacacagagaaaaacacactgaaaagcctcaacaatagaattgaacaagcagaagaaataacttcagagcttgaagacaagattttgacttagccaaatccaacaaagacaaagaaaaaaaaaattttcaatgaacaaagcctccaagaagtttgggattgtgttaaatgatcaaatctaagaataattggcatccttgagatagaagagacatctaaaagtttgggaaatgtattcaaggaaataatcaaggaaaactttcccagccttgctaaagacctagacatccaaatataagaagctcaaagaacacctgggaaattcattgcaaaaagatcattgcctaggcacattgtcatcaggttatctaaagccaagatgaaggaaagaatcttaagagctgtgaggcaaaagcaccaggtaatctataaaggaaaacctgtcagattaacagcagatttctcagcagaaatcctacaagctagaagggattggggccctatcttcacactccttaaaaacaaattatcagccaagaattttgtatccagtgaaactaagcttcataaatgaaggaaagatgcagtctttttcagacagagaaatactgagagaattcactactagaaagccagcactacaagaactgctaaaaggagctttaaatcttgaaacaaatcctggaaacacatcaaaatagaacctttttaaagcataaacctcacatgacctataaaacaaaaatacaataaaaaaaaaacccaagctacacaggcaacaaatagcacaatgaatggaatagtacctgacatctcaatactaatgttgaatgtaaacggcctaagtactccatttaaaagatacagaattgcattattgataagaatatgccaaccaagtatctactgctttcaagagactcatctaacacaagaactcacataaacttaaggtaagggggtggaaaaagacattccatgcaaatggacaccataaacaagcaggagtagctatatttataacagacaaaacaaactttaaagccacagcagttagaaaagacaaagagggacattatgtaatgataaaaggtcttgtccaacaggaagacatcacaattctaaatatatatgcacctaatactggagctcccaaatttatgaaacagttactactagacctaagaaataatataaacagcaacacaataatagtgggggacttcaatactccactgacagaactaaacaggtcatcaagacataaagtcaacaaagaaacaattgatttaaactgtaccgtaaaacagatgaatttaacagatatttacagaacattctacccaacaaccatggaatacacattttattcatcagtgcatggaactttctccaagatagaccatatgataggccacaaaacaagtctcaataaatctgagaaaagtgaaattatatcaagtactctctcagaccgccttggaataaaattggaaatcaactccaaaaggaatcttcaaaatcacgtgaatacgtggaaattaaataacctgttcctgaatgatcattggatcaacaatgaaatcaagatggaaatttaaaaatttctcacactgaaggataatagtgacacaagctatcaaaacttctaggatacagcaaagatggtactaagaggtaagttcatagccttaaatgccttcatcaaaaagtctgaaagagcacaaatagacaatctaaggccacacctcaaggaactagacaaacaagaacaaatcaaacccaaacccagcataagaaaggaaataaccaagatcagagcagaactaaatgaaattgagataaaaaaatacaaaagataaatgaaacaaaatctggttctttgaaaagataaataagattggtagaccattaggaagattaaccaaaaaaaaaaaaagaacaaagaaaatccaaataagctcaattagaaaggaaatgggagatattacaaccgacaccacagaaatacaaaagatcattcaaggcactacaaacagctttatgcacataagctaaaaaacttggaggagatggataaattcttgggaagatacaaccctcctagcttaagtcaggaagaattagaaagcctgaacagaccaataacaagcagcgagattaaaatggtaatacaaaaattatcaacaacaacaacaacgacaacaaaaaagccatgaccagatgaattcacagctgaattctaccagacattcaaagaagaattggtaccaatcctatcgacgctattccacaagataaagagggaatcctccctaaatcattctatgaagccagtattaccctcatacccaaaccagaaaaggatgtaacaaagaaagaaaactacagaccaatatccttgatgaacatagatgcaaaaattcttaattagctgccagctaactgaatccaacagcatatcaaaaagataatccaccatgatgaagtgggtttcataccagggatgcaggaatggtttaacgtacacaggtcaataaatgtgatacaccacataaacagaattaaaaacaaaaatcaaattattatctcaatagatgtagaaaaagcatttgacaaaaatccagcatcctcttatgattaaaaccctcagcaaaatcagcataccatggatataccttaatgtaataaaagccatctatgataaacccacaggcaacataatagtgaatggggaaaagttgaaagcattccctctgagaactagaacaagacatgaatgcttactctcaccacttgtatccagtatagtactggaagtcctagccagatcaatcagacaagagaaagaaataaatgtcctccaaattggtaaagaggaagtcatacagtagctgtttgctgttaatatgattgtatacctagaagaccttaaagactcctccaaagaactcctacaactaataaatgaattcagcaaagtttcaggacacaaaattaatgtacaaaaaccagtagctctgccatactttaatagcaaccaagctgagaattaaatcaagaactcaaccccttttataatagctgcaaaaaaaaaatacttaggaatatacctaaccaaagacctattcaaggaaaactacaaaaccctgctgaaagaaatcatagatgacacaaacaaatggaaacacatcctatgctcatggatgggtagaataaatattgtaaaaatgactatattgccaaaagcaatatacaaattcagtgcaattcccatcaaaataccaccatcattcttcacagaactagaaaaaaaatccaaaaatattgtatctatatatctatatatactatatattatatatctaatatatctagatatatatgtattatatatttatggataacatatctccatatatactatatatagtatatgcagttatgtagtatatataactatttataatataatatatggatatagtatatgtattattatataatacataatattacattatatattatataatgtgttatatacaatataaatgtataatacccatatattatatataatatatccatataatatagtatatatattttttatatatatatatatgtattttttgccacactcctgtgcctttcttcattccaagctcatggatatataatatatctatatatctctatatctgtctatatatatatcatcttccatgaagtccgtatggtatgggagggagacagcatgagcttggaaggaagaaaggcacaggagtgtggcaatgtatattacatatatataatatatatattatataaacataaatatatataaaaaagaattttttatattttttaggtatatactatataatacatacatagtatatattatatatatatgcatatatatatatatatatatatatatacatatatatatataatgaaatactactcagccatgaaaaagaatgacttagtggcattcgcagcaacctggatgggattggagaccatcgttcaaagtgaagtaattcaggaatggaaacccaagcatcatatgttctcagccataagtgggagctagggtatacattggtgcaaaggcatgagaatgatacaataaactttgaggacttgggggaaatgatgggaaggaggtgaggaataaaagggtacaaagtgggttaagtgtatactgtaagtgttaagtgtatactcctcgggtgatgggtgcacaacaatgtcacaaatcaccaataaagaacttatatagaaacaacaattatgacagctgtaatttctaaagtgattgtgttaggtcctgtgcactagatggataggacctgggatttaggatttatcagtccagattcactttaaagaaaaggatgctacttgtattagttagcatttgctacagtaacaaacaccctatacatcttagtagcttttagtcatgcatattttcccctatgggtctgtgtgttgctagtggccatgctaggctcagctcaactccacatttcttgttgttctgggtcccagtctgaaggtacagcatgatctgggttatgcaagtctcatgcagaggggagaaatgtgagaatttctgatgaaccgtagaatcccagacactcacatctcgttgaccaaagcatatctcatgagcaagccaaagtcaatgagaggtggatacatattcttcctcctaaatgcactgggaagtcacttgaaaatgaatggggatttataatcctagaatggaaagggagtgaattgctgggaacaactatcccatctatgacccactgtattttaagcacaaggggatttattacatggaaatgggcgttcacaaaactgtcagaagtgttgaagatgtgggatctaggactgggtctgtatcctcttatgcctttagaaaacagcaccccacaaggagactgaaacagatgctgagtgccaatttactcataactacagcaaattaattcctgggaagaatcctataaggttgggatgaatctcctgaagctgctgatgatcagtagagcaatctgttaaagaagctctcacctgtgtctcttctttcttttacaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggtaatggggtggaaaagaggcacagagtgagacaattttgttgacttttaaaattcatccattaattcagtaaatatttgttaagtacttattacatgtaaggcactgtaataagctatggacaagacactcgtcttccatgaaggcagtatggtatgggagagagacagcatgagcttggaaggaagaaaggcacaggaatgtggcaacctggtaactcccaggcagccaacacacagtttgtttacactatatgtagactgcacatgctctgttgtgacctcccagggtgaaatgaggacttttggtctggggtcgtagaagaggcgggtttgaatctaataatagcaaatcaagcctgggcaacacagcgagactctgtctctaccaaaaatgtttaaaacaaaattagccaggcatggtggcacatacctgcagtcctagctactcaggagattgaggtggcaagattgcttgagcccaggagttggaggctgcagtgaactgtgatcacaccaccacactccacagagtgagattctctctcaaaaaagtggggggcaaatcagcactgaacaaagactgagtcttcccagaaagttaggtcacgtgtccctgtcaatagaggtgtgcaagtaagatagctacgaggtgacagttatcaaaagggcttcaatatgagacatccaagaaagaaaaagatgaagaaatttctgagtttccttcccagccctgagcgtctagaattttaatccattcactgctgatccatcaattgccttcacctgaagtcctatgactctttctgtaggatggaaggattcattctggctagggtaggggaaggggtggagctaccagcgtgaacttaatacattggtgctcaaaaagagtcacgattatgacatgatgtcctaagttccctacactatgaaacagtcttagtgtggagattgcaaatgccttgcctctaggctgaagacggccctaggtgtgggtactcttaaaaaaaataaggttcaacattttaaaattgaaaattttcaaacagaaatttagatttctggattttttaaagttatacttcctttaaatattgaggaaggccctttaaatattcaggaaggcccttactaccatgactcaccattctgaatccataaaagtaaatttgctatataaacatcaaaaaatatttccattcacaaataacaccattagcaaaataaatgactaatgaaaaccatggagaaaatattcaactcatataacagcaaaaaagttaataatataaagtgagcttgtagaaaccaagaataaaaaggtgcaactcattataaaaccaggcaaagtatatgaacagatagttcacaaaaaagtgaactcaaatggccattaaatataaaaatttctcaccctccctcataataaaagtaatgcaagtgataattttgctgaaataacttttatgcacctgtcttgttagtcaaatacaaaaggttgtttttttctttcagaaaaaatagtttaattatcacaagacatcttagtggaaggatgggaaatatttctcaaatctgcccccttgaaagctcagagactagggttttcaaagataatttggagggcagggggctaaggaatgggtgctactgattgcttaggaatgaaattatagagatgtgagaaatgtcttcaagtgctgagtttgtttctgggtgaggcagacacaggacaggtaaagtcagttccttgctgtagaatcacaggtctaggtagtgtcagtaacttttccagaatgcaaatgtctgaaaaatatctcaaaggtcagtcttagattttacaatagtgatgttaactacaggagcaactggtgaagttacaaagtgtgacttctggttacatgactcctaagcagtaagcaagctagggaacaatggctggttattgcttaactatgcttatagcttagcagaattgagacccctaccatctaccataattctaatgctgtggaattgcattaatttcacaaaggggtttaggtccctgaacaagaagggagttggtttcaggaagagactgttgtcatccttgctttaaagttaaattataaactaaattcctcctatagttagcttggtctatgcccaggaatgagcaagaacaaaatacaaatctttaacaactctattagcaaggctgtgaggaaacagacactctcatgtgttaccaaaaagtgctataactctgatggaggcaaattttgaaatatctaataaaattgctgacatgttttgtttttgattttgcatcattactctcaaactatgatctgagaacccctgaggatacatgagactctttcaggggatatgcgaagggtctattttacaataaaacagagaaattagaacccttatgcatcatgatgggtatgtaaaatgttacagctattatggaaagcaatataacattttctcaaaaaattaaaaaatagaattcccattcagcaattccaactctgggtatacaccaaaaaaaacttaaaatcagggtttctgaggaatatgtgtacactcatgttcacagtagctttattcacagtagttggaaggtcaaacagcccaaatatctatcaacaaatagacaaaaaataaaccatcattctcagcaaactatcgcaaggacaaaaaaaccaaacacagcatgttctcactcataggtgggaattgaacaatgagaacacatggacacaggaaggggaacatcacacactgggcctgttatggggtggggggaggggggagggataacattaggcgatatacctaatgttaaatgacgagttaagctgtgcagcacaccaacatggcacatgtatacatatgtgacaaacgtgcacgttgtgcacatgtaccctaaaacttaaagtataataataaaaaaagaaatatcaggcaaatccaaccaaaaaaaaaagagaatattgtatttttcaatgtgagaaggacatgagaattggaagggcaggagcaaagtgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgtgagccaattaaacttttttctttataaattacccagtgtcagatattcctttatagcaatgcaagaacagcctaatatagtaccttatataaatgaaatcacacagtatttggttttttgtgtctggctaatttcacttggcatgtcttcaaggtttatccatgtaatatatgtcagaatttccttcctttttaaggctgaaataatattccattgttatgtatatgcaacattatctattcatcaaacattcaggtcaaatcttgaatgctctgttgcttaaaaatttcttctctcagattccctaagtcattactcttacgttaaaacttccacagatcactaggctatgaacacaatgcagccaagttctttgctaaaatataggaaggaggacctttgcttcagttcccgaaaagttccttatttgcatttgaaatctggtcagcctgcatttcattgtccataattctatcagcattttggtcacaactatttaaccagtgcctaagacgttccgaacttttcctcatctttctgtctcttctaagccctccaaactcttcgatttcttcccatgacctagttccagagttagttctacattttcaggtatctttacagcaatatcccacttctggtaccaattttcggtctcagactgttcttgtgttgctgtaaaggaatacctgagactaggtaacttacaaagaaaagagatttaattggcccaaagttctgcacagtgtataggaagtgtggtgctggcatctgcttctgatgagggcctcaagaaatttacagtaatggtggaagatgaagaaagagcaggcacaataaagggcaagatgaggagcaagacagagagtgagaaggtgccactcacttttaaacaaccagatcttatgatctcatttatcaccaaggggatggtgctaagccattcatgagggtcccacccccatgatccaatcacctcccaccaagccccacctctgacattggggattgcatttcaacatgagacttggagaggacaaatattcagacaatatcatgtatctagaatagtcaaattcatagagtcggaaagtagaatggtgtttatcagggcctaaagggagaggggatgacgggtgattgtgtaacggggacagagttttcattttggatgatgaaaaactcgggagatggatggtggtgattgttgcataacaatgagaatgtacttaatgccactgaactgtacactcaaaaatagttaaaattggaaatgttatgtgtatttttactacaaaattaaaaaaagtaaatagatagagatacatatataaataaatctaaagtgatatttgcctttttattctaattctttcacgagtatacaatagcattttccagaaggtacatgttggtactcacaacagagtgaatgcagaatcagatgagaggatccaatgtttttctactaagacgttaaagggaattgcagaataaatagacgcaataaataaataaaataatgccactttcctcattattttttcattttgaaaagtttactttatcattataaaaaaattatgcatgctaatatataatgggtttattacagttatttctaaaagcatacatttacaaaaattctgttttaatatctactatggtagatattgacagatataactcatataaataacaagtctttagaattttcaataccttttaagattgtatggaggtgctgagataaaaaaccttactaagcaccaacttggcaatcccaagacttggaatttatcctacctgcttgtgtaccaatgccccctgatcaacagggcttctctttcctcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggttggtaactgactacctggacagagaactgtcttccttgtgaagaaaactgatagcagagaaatgcagccacctctctcaaaagaagtctcctccttggagcatgctgtcctgtatcatatgaagaaagacatctccctacttccacttatttaagcaaactatgtgccaagcacttatgcagggtgaacaacaacaatgacatagtttacatattcatgggacttacagaactttggagaaagctcttaaactattaattgcacatgtaagtatttaatcagaattatgataattggtatgagaattctattaaaatctataaaaataaatttggcagactgtgacctgcaggccaaatcctgcccaaagcttgtttttgtaaataaagttttattataacacagtattatatgtggctgcagttgcactacagtggcaacttgagtagttggaacaagagagtgtcttatccacaaaacctaaaatatttactatttggccctttgcagaaaaagtttgccaatgcttttctaaaagaagacttgaattaaccaatatgaggagcaactaagtctcaatggaagtgatatttgagctgagatctgcaggatgagtaggattttgccaagagatagagaggcttgtgccaagcaaagggaacagcatatgtgaagatgtaattatctgatgatttcttcttgtccacttcccagaaaagccaaacactgaaaacagtaggagttgtggtagagaagagtttaataattgcatagacagccaagttgaaggatggaggatgtttcttaaatccacctccccaggaaatcagagactagagtttttcaaggatgctttggcttccaaggggctaaggaatagtaaatgctgattggtttggctggggatgaaaacatgggttgaagctgtcttcttgtgttgagtcaactcctcagagatcacagaactagttgagttagtttcttggtatcagttactgatctgggtagtgcaagctggtccatcagaatgcaaggtctgaagaacacctcaaataccagacttagggtttaccataatgatgtaatctataggagaaattggggaggttacaaatcttgtgacctctggctccatgactcctgaactataattctaaccttgtgacaaatttgttatttttctaaaggcagtttcaatctccaagcacggacacagttagtttcaggaaagagctattatcatttttattttaaagttagactataagttagatttctcccatagttagcttggactatgtccagggatgagcaaagatagatagcttgtgaggttggaaacaagatgaagtcagctatgtcagatttccctcagtgtcataatttttccaaaggcagtttcaaagccacagaggagggaaacttgaaaattataaaagaacctaaaaggatatctatgtgcctgaagtccaggccataaaagaaagtagtggcaatagaatgaacatgtagaggtggccaggtgctaaactggcagtgccttgtggtccttggtaagagttgtggacatttatccagtggtgaatgggaaatgattgatggattgagtgacactcaaaccattgatgcattgagtgacactcaaaccattgatgcactgagtgacatgatcctcctctgtttggatggtcatattggatgctcaatagggaatgggatgaagaagacaatagtggggttggaaatctcagataagaggtgaagcgatggtgatggcttcagtttcgttgaggtagtagagatggagataagtggatttaacaggcaattggggggtgaactaataacagggttattcaaaggagatgcgagggagagagagagaagtacagacatttcagcaagtgggtggatggtgctttctttcactggagtgaagaacacagatatagaaagaggtattagtgtgttaggaaaatatcacaagttcaatttgggcatgttgagtccaggatgtccatgtgatgttcaagaagtgataacaagttggatttaaggctctaaaatttgacatggagacagaaatttgagaatcatcaacttttacattaaaaggatgagaagtacagtggtatcaaaaagaaccccaagaaactccagcaacctccttcacaaactgccctttccacctctgcttgcacacagcctaatcccaactaaaagctccaacccacctcatattctggggacaatgggctgagcatgagaaagcaatgggtaaagagaaagacatgaatgcagccaggaattagaaactatcagaggcgaccaaaccaactgcaggaacttggaagcctgtggaaagagagaacaagccagagagaaaggtgacatactgaaattatagccagaaggaaaggagaacccagaggaagagatgtgtctattgttctgtgtctgactcaattggccaccatggtagagaaacatttgaggatatttacaggtatgcagtgagaatcccaaagtgttgagagtgggaagaaagtgagctaaggttaaaagctatttaacaggacaggcatgtggtttaagcttcacaaaaaatgaaacctgtgtagttattctgttcttttctttctttcttttatttttttgagacggagtctccctctgtagtccaggctggagttcagtggtgcaattttggctcactgcctcccaggttcaagcaatcctcctgcctcagcctcctgagtagctgggattacaggcgtgtgccatcaagcccagataatttttgtatttttagtaaagctggggtttcgccatgttggccaggctggtcttgaactcttgacctctaataatccaccctccttggcctcccaaaatgctaggattacaggcatgagccaccatacctggccctaagtctagttattctacagaatattttaataatcaaaggagtctcattaaaataggaaacaagaacaagaatttaggaaagtgataatcatggggtataaaacctcatttatgtgcaaggaataagtctaatgttttaagataaattgtacagcatgctaaacacagctaataattcagtactgtaaatttcagtatcattaagagcaaaactttctaatgttctcatcacaaaaaaatgttaaatacttgaggtgatggatatgtgaattagcttaatttaatcatctcacattgtcttcaaaaattataataccactttgtacccaataaatatatacaactatactttgtgtgtacatagatatgtaaaactgaaggcactctcatctaagaaaaatgcatttaatgtcccagggatgaaataaattgccaggacctagagctattggtgtttcaagaccatggacagttccaagtgcctttcctcatgattctttaattatcatatgagagttttgaatacagcaaactcctgtagaaaattttttttgaggggtgagagtgggtgaggagaattgtatgtgtcttagactatcaacaatgtgacattagcaattcaatttcttttctttgtctcagtagggcccttaagactctgacaacccagggaatcctaggtttcattcactcccttgtccttagttcccttttttattgacactctctattggtcattacttcctcatcctctccttccccacttgctcgctgcttgatgtttatctcaggcttctctagggacaaagaaaatcatcctttccaattctctaaattgttggcttctttaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaagtgagtatctacatgtctcagcctgggttttaactaaaactggaaacagagccaagcacttaggtgcaggtgctttattgaggaggtgcagaaagaacagcatgggactaggaagagtgaagctgggaagaaataaaagctaacacaagggtattttttttttttttttttttttttcaaatcattgcaaggactaaatggggcttgatctgcctggaccttctgagcagcatatagaatgcctcccaggattgtcctctaaaggattgaaaagcactgatccattagcatctggtccccacaggttcagggttgtcctgggggtgttattgcctccacacttctgggctgcgcactcatgcgtgaagagtggctcagagttccatgctatggtaaaacagagaaactatggggcacaaagtgaatcacttgtgatgcacactggaaacaacatgatgttaacaccaagtgggttgaaacccacccagaacaatttactggaactatgactcaaatcaggggtgaggccaaggtcatgagggaaaacccaagagatggctgatataccaagtttctgggctcttctttccacctcttgtatctctaagagaggctgatcaagggcagaggactttccatgtgttgatagcatggaaagaccttgatagtccttccaaaagccgatagcaagactggctggattaatgattttctctgtcaacatgtctgaaatccctctagcaggggcacatatgataggaaacttgaagggataacttcagcttttcctttctaatgccatggtctttaaggtagctgtcatggaaataaacaccatcatgcctgcttttaaaggctcaaaatcaggacactggagatgtccaagagatatgtaggtgcttccagggaatagaagagaatgccaagaaagtacttggaaaacttgtattaattccacccctcctgtccacttggtgtcatgccagagctcttcacaacaattagattagcatttattgagttcttactaagcaatttgctcatttctttggtggtagagataactctataagacttgatctcactttttttgcagatataaagtcagacacagagacgttaaataagtagtttaaggttgcattgataacaaagtgtgaaacttcagtagttttcaaacccaactctgattgactcagactcccatgatcttaatcactcagcagcctctcttgtgaggtgggtccatcaacttgcccttttcagcacagtgggtggtgggaaaagatgggtcactttgatatctggtgtccagtctagctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctgggtaagctgagctctttctctctacagagaattacatgagttttggagttagaaggagaatgagacccaattatatattaagtcaggtcaaccggggtcccaccttctgaacattcatctcctgttgatacaggatgtgtggatagaacaacttttcttcccccttcctacttatacatagacatatgcctataaacctgcaggcagatacacacacacctctgcacacacacctccctttcctcccctacaccttagtgtcccacgcatcctaagcatgcacccacctatatgtacatgtgttttgtctgtgttttcagttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaaggtaagagaggatccagtttgcagcagttattcagagtgagcccgaggtttgcacacttcaatttattgtagtttgtttcaattcatctaatttttgctaaacccctgccatgtggtgaacagtgttcagtaaacgagatggaaatggtccctgacctcacagagctcatgttctggggtaggagagaggcacatatatagataaaaggagtatgttcaggagaaagatattgtaggtcatttgttcactcaacaaatgtaacgggctcttccgctggtgtcacctatcagatagatgctggtgaaccacgtgtaaaagggaaagctggagtattggaggggatgccatctcgctctcatgagtgtgtgtgtgtgtttgtgagtgcacatttcatttccttttttatttgcagcataacacacaaactgaaggtaaagtacacagagtgccaccatcctatgtgtacagtttgaaaataatttagctgtgttagatactgtcttagtcagcttgggctactataataaaataccatagtctaggtggcttaaataacagacatttacttctcatagctctggaggctgtaagtctgagatcagggtgccagcataattggattcctggggaagccctctcttcctggcttgctgatggctcccttactgctatattctcacatggttgagagagacagtgctggtatatcttcctttttacaaataaaggcactcatgctatcactggggcacctgcttcattaccttgcataattacccctaaaagccctgcctccaaataccatcaagttgagggttagagctttaatatagggatttaggtggggacacaacatccaattcatatcagacacccctgtaaacaccaccagataaagacatgaaacattcccaccactgcagaaggtgttcataccccttctctgacagcatctgccccccataagttaatcattcatttgatacctatcaccatagattaattttatctcttcttggaatttcatgtaaatggagccaaattatatgtaatcttttgcatttggcttcttttactcaaaatattctctgtgagattagtccacgtgttgcatgtatcagatgtttgttgttttagctggctgcaaagtatttcattatgtgaatctgtaaaaatgttcccccatcctattgttaatgaactttgggttatttccaatttaagatggttttctagaagcaattcagaagaataaatggaattttttcctgtagaacttgatggtacagccattaagtaagacccacagactgcagctatgcattatcctgtagcaacaaagcaatgaaaatgacctcattttgcttatgaagatacaccctatgttggactctatgatagagggattgggttatttccctgctgtgcccccagatctctaatggcccatccagacatctatttggctgcagcaaaggttcaagctaaggcatagatgacatcttcaaaagtcaaaaagtcaggtgtgatctggattttcataggaaattatcttcaaataatactgtcattctctgttttaagcaaattcttactctgtgtccttctcaaaaggacttgaactggtttttattaagttccaccattaaaaaaatgaaaacagacataaaattataaagcccattgggaaaatttaggttggaggtgtagggtggaaaagactaaggaaattaaggagaaatatagcaaatgagtatgtagttacaagctgagcttctagtaaggcaaagcaataaggaatatgggatcattttcatagcttatatctgtgtatcaagcacacttgaaggaaattattgcatgatactcacatttgtcattttttctagaccttttgcttaaaccattgccatggtttgaatatttgtgccccccaaaactcatgatgaaacttgtaaaccaaaaataaaatcctaaggccccatcccgccagccatctgaatggacttcctccttagccagggttcttttaaaatttaacctgagagactgtttcaggccatgataggaagtgggagtgggacatgcctcattatacctctctggtattaacatcaatacagactttaagtctgattaaaaaaaaaagattacaacctgttctgtctaaagcctagtgccagtacctaaaagcttcctctgcaaataagaacttgggtctccacaattatttatcttaactaaggcattcctttctattgatcccaggtctttagataaactcaaccaattgtcaaccagaaaaatttaaatctacctataagctggaagcccccgcttcaagttgccccacctttctggaccaaaccaatgtattttttaaatgtgtttgattgatgtcttatgtctccctaaaatgtataaaaccaaggtgcaccctgaccaatttgggcacgtgttctcaggacatcctgagggctctgtcatggccatggtcactcatgtttggctcagaataaatctcttcaaatgttttacagagtttggctcctttcatcaacaaactcaatccccagtgtaacagtagtaagcggtggggcatttaagagatgattgggcctcatgagggattaatggattaatgggttatcctgttagtgggttagttttggagagtgggtctgttatataaaaagccagttttgctctacctcgtgagcccctttacaatgtgatgccccgaccctccttgggactctgcggagtccccaacagcaagaaggctctcaccagatgcagcttcttgaccttggactttccagcccctagaactgcaagaaataaatttattttcttcataaattactcagtctccggtactcagttacagcaaaagaaaacagattaagacaatactctattacattctgcataaagaaaagcatgggatggagatggtgttatacgacaggaatacatgctgcaaataatgatcccactacttgctgactaggtgaccttggagcagctacttaaccttgtacatcatgggtttcccctctgtatcatgaggatgatagcacacactccgtgaggttattgtaaaaattaaatgagataacacaggacatggcaagtattcagtactaggtctttttgcagcacttgttttgaaatgtctatagatgtctttagcttttcaaagaacttttatatctaaaatatattccaaaaatattttcaggaaaataaggctggaaacaatctattataaagctggctacagaaagttaaggaacttaaccaagacagctgctgtgctcaggcagctgatcttcccttagttgctggggggtgatctactcctaggggtgtgttaacgagggcaagtcttaaactggcaggaacagacatccaggatttgacaaaaatgtttcaaattagccttagactttttcactacaataatatgtattcatttccctgttatttgtgtcttcagggtgcatgagagttgtggggctcatttaacctgaatcagacatagtaaacaagctagggttttcatccagacctctacaactccatagctcacaattgtaaccactgtgcatagccataagttggcatttgacctggtgaccaatgtctcacctggctcttgtcttccagacactctccagttatccaatcaagagtatgatgggtgcccccattgtttaccggatgttgctacagcaggatctttccaggtgatggggctttgaggattggtaagagagtctggccccatccccctgactccctcacatacattcatgcctatctatctgaatctctcgcacacagagagccccatgaagccatttgcatcatcaaagcacccagaaacccagtctaggcctgagtggactttggttccagggaggctgagggcaaacatttatttctcttcttcagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgtgtgcactttttgggcttcaaaattctctttgacaataaaaattgttagccaccatgtatcattcatctattcgagaagtatttattgagcctctatgaagggacaggtactgagtattgaaaattccgcacagaacaaaaaaggcaaagttcctgttttctgggagattacattccagtgagatttggggagagagaaaataaactaagaaatatctagcatggcaggtggtgagaaatgcgatggaaaaagtaaagtagatgacatggggtgagaagttggtaaatcagatatggtagtcagaaaattcctctgtgatggggaaacattttagcagagaccaaagtttatcaaacatgtcaagcactgtacaaagctacttagactgaagtgaggaatgggaagaagaacccaccatgactttactgcacctcctgacatatcttcttggaactcttgaggtctcatgtgcacaatgtggatttatgctattctatactattttacttatcaaaactacatggggaatacttttccccaactcttcttctcctttttccagtgcctcttacttgtgactctcagcacttcttgcctcttcctctccactctcttaccctgcatccttctttggctaatgagtacccttggaagaacttttgcagaaggttgacggcagctctgtggtatgaaagagccaggaagagctctgcaaatatgaataaggacaatggagttgtggcaagcataccctggcaggggcctcccaccattcagaggaggacatgtttaggatatgcttacaaggacactcaggttcccatgatcttaatcactcagcagcctctcttctgaggtgggtggataaacttgccctttccagcacagtgggtggcgggaaaagatgggtcattgtgatatcttttgtccaggctagatctgagaaaatgacaatctatgtctctgtcagtgaggcatccaccactcatttgttattctgttgggaaggttcatttcagggttcaagcagaactggtgctgccatgggagatactttaaaaagtatattttactgcttgaggaaatggatacttcattcttcatgatgtgattatttcacattgcatgcctgtatcaaaacatctcatatattccataaatagatacacctatgtacccacaaaaattcaaaataaaaataaaagtagtatattttaggccttacagattgcatattggtgatcccatatagtttgaaagggctttgggtatccatagtgtcgtattaaaatgtggttccccctaaaagagattataatgtgattgttaggtcctcttcctggggagtggtagatgggttgcttcctgaactaacaatttagcgaagcccctaggattgtggttccagtaatggggagagagccagggaatgaggagcagggggagccaccaagtgcaggccaagttcaggacagtgtcaggacctgctctgcagaaattttttctttttctgtgaccttgtacctcctcctgaggtttgctgatctgtctgcttctttccacagggattaacttgcatggtttccaagacaatgaaaatcaaaccaggatacatgggaacggctgcttcctgttatgatgtacaggtttgctcgggacactgaggagggaggaagttaggggaaacactgattttcagtgatttatgttttccattgtttattgagtcaaaaataatagaaagtactgatattaagataacataagaaaaaaaggaggtagggaggttgggggaaggaaagagtgagggaaggaaggaggaaaaggggaaatgatttatattcttaccatccagaaggacccactttgaatagctagcaaattagctagacagtacacaagtatatatgctttaaaaacagaaatggggtgaatcttgacataatattttgtaactagcttttatcatttaacaatttaggtaaggatcttttcagttcaattaatgccaacctgcagcatgatttttaatgatgtagtaaatagtatatatccactgctgtttatgccttttattggaccaagggatgatgtcccagttttcactagtaaaaatacactataatgaatgtgtagtagctaaagttttattgctttctcttgttgttttttgagaactagaatttgtgtttgtgtatctgtgttatgtgtatagttctgtatatctaaagtgtaacttagactctattcagtgtcatatccagttacttgccatgccattcactatgataaccatttgctaagcccctttcttagtatcttatttcattcctataaaaatcctgtgaaataagctgtcagtatctgttttatgggcgaaagcactgaagcccagagtttaagtagttcaaagtcagctagtaaggtagcagagtaaatttgagttttgatctgcccgatttctaagtccacaggtgaggcaggtctcaaagataagaggaggctattactttatctgagctcctagagccaaaagcatctccccaggctcatctgggccagtctcaataaaaggattcacctaaactattccaggcagatagatcagagatctgagtttaagactcttgggttcccctggcttctggttgttgttttcagtctccactagagcaagagggtctttcatttgaccaattcagcaatctcatgatgccattgaagccatctcctgctgtgtgcatcattcttccaatctgcttctttctccagatcatagatgataagggcaacgtcctgccccccggcacagaaggagacattggcatcagggtcaaacccatcaggcctataggcatcttctctggctatgtggtgagaaactgtgctcctcctcctctgttccccagtgaggatgggagcactaaacgggatgagggaggacaaatgttctgaaacttccaagaggcactagatgtggagacaaagactgtccagttttcaagaatgtatgctttgccagtggaagaaaagtggctattcagccttgccatcctcagcctatcactgtgatctcattggaagacttatttttcttcagttagcccttagactcctcaagaactctctgtttcatgcccaaaatattattgaccctgaactatacacagcaccattcccccaagggctgcctttccctctcccctaggtatcatccccatgctctatgccattgatcttctttagagccatgccaggcactttacagtaagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaacaataaatcaaataataatagtttctaccatttattgaatgcatatcatgaggcaagcattgtcctataaacacatttaatctttaaactttaaactcatttaaactttaaactcgtttaatcctcccagccaccctataaagtttttggactcagtttgctcgagttcaaaaccctgctctactatgtattgcatgatcttagggaagttacctatctgtcatgtctcagtttcctcatctgtaagttgtgtgtcgtgagtgtgttaaataaaagaattgttgtagatccaaatgattattcctattatacagatgaggaaaactgagcctcagtgatcagggcagagccacactgtccccttctccaagcatttcctttgtgtggtcccactctattctcaaatgccagtgaagtactatgtcatgggcttctccccatttgacagaaaaggaaacagactcagaagcgtctgtggggcagactcctaaggccacagaggctccatgatgcccatgagaaagtcaatccagtggccaagaaacctggcttctggtctcagttctaccttctgtaatggctgtttagcttcagactaacctcttgatgtctctggtcatcagtatccctatattcccaatgatagagtgaggctaagaatcctttatgccaccatatataatccagtaactgaacttccagtctggagcccatgcccctatacctgagtcagataggaagatgcactgacaagggataaacctcaagccttttcattgcttataagcaagtgcctcagctgaatagacggacccagctattgtagaaatatgcacattagccagggtcccagggggcttcctggctaatgtctctagaactttcaaatttaacaaagaagctaagaaaattacctaatcaaaatgatagctttgagtggtgctatggagtgagcagagattaggatatctatgaaaggagagatggaatcaattggggaaaatgccctaagcatggatgaatgaatacatcaataatatctatcagactggacctagaggagtagctgagagaccctgggtggaataacttcaataaatgggaaagatccagttctgcctgtggcctagggttggctggttcagggcatgtctgccatgttcaggttatacactgcacacctgcagttttaataagactcatagcatttgttcatggcagccccagggcaggggatttaggctttgcaggcacaatgactctgtctttctgtggtcaccaggacaatcccgacaagacagcagccaacattcgaggagacttttggctccttggagaccggggaatcaaagatgaagatgggtatttccagtttatgggacgggcaaatgatatcattaactccagcgggtgagcttggtttctgggttgggaagggaaatctgggtctttactctggctggttccagacttctggaatggcctagaggttcggtgtccagtgttctctgaaggacaggttcttctgcaggtaccggattggaccctcggaggtagagaatgcactgatggagcaccctgctgtggttgagacggctgtgatcagcagcccagaccccgtccgaggagaggtgatggggaagcagtagcctgggggtgaacacatatgaacacaagggcagtgtagtatgatggtttaagaacagggactgtggggctgaacactctgagacccaatcttggccctgccacttactagctatgtgaccttgggcaagctacttggcctctctgtttctcagtttccccatctgtaagatgagggattgttatgagggttaaatgtgctaatatttgtaaagtacttaagtatggtgatttctaaaaaaactaaacagaactaccatacgatccagcaatcccactactgggtatttatccaaaggaaaagaaatcagcatatcaagaagatgtccacactcccatggtaattgcagcactattcacaatacgaagatatgggatcaacctaagtatccagtggatgaaaggataaataatatgtggtatatatacacaatggaatactatttggtgttaaaaaagaatgaaatcatgtcatctgcagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaacttttataaagtaaagtgcttggttgggaggccgaggcagatggatcacgaggtcaggagtccaagaccagcctggccaagatggtgaaaccccatctctactaaaaatacaaaaattggccaggcatggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaaaaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggatcccctgctgagaaaatcctgtgtgcccagctctgagctagccctgctgtatatgatttcattttatttaccgtaagttaaatttggcaattttatccccactttacagatgggaacactgaagtttggagaagttaacacattgtttagggttatggttttcagtctatttttctcttttctccccctgtatcttctttctccttatctgtctctattgttattggagtatgaggtgagcctagtctcaatcttttgtccacctgctcctccaataaatgacttcagagagagctgtaacctcattcatgtccccagttttctccttttcccttgacctggatcaccgggggtgcaaatgaggagatacaagggtgatggaagtcttaatgccaatttcacattattccaggagatgactacacactctaatcccttctctctggccttcatcttttttgcaggtggtgaaggcatttgtggtcctggcctcgcagttcctgtcccatgacccagaacagctcaccaaggagctgcagcagcatgtgaagtcagtgacagccccatacaagtacccaagaaaggtaaggcctttgagctcccaagtcactcaaacttgagaaatagattgttttcctgttatatttatcttcttcaggaggaggacagtcctctaattttaaaaagtcttcctggctgggcgcggcagctcacgcctgtaatcccagcactttgggaggctgaggcgggtggatcacctgaggtcaggagttcaagatcagcctggccaacatggtgaaaccccatctctacccaaaatgcaaaaattagcccggtgtagtggcatgtgcctgtaatcccagctactcaggaggctgaggcatgagaatcacttgaatctgggaggtggaggttacagtgagccgagattgtgccactgcactgcagcccaggtgacagagtgagactctgtctcaaaaaaaaaaaaaaaaaaaaaaaaaaaaaaaaagtctttctatgatcaagaaagcccagaaagacaatctagcttgatgcctgaaaaatgacctcagcttttgactcactctgaattaaaagccaaatgctatcaagggaataagttctagccagtatcttacctgtattcccattctctgcactgggttcttgctatagtattcagggttgtgcaacgctcagttgcaagtgacagaaatctagcttgacatttattgctcatgcaattgaaaagtccaggggtggggaaagctttcattatggctagtcccaggcattcctaggatgtggtcaggtgtctctctttcaccctttgactctctttcctttgtagtggtttgatttcttggaatgctttttctttgtggctctatcagctccaaacatatattctcagcagcttagaaaactccagtagaaaatgagcatgtttttctccaaaggcctcaacaaaattctctgggttgactctcactggaccaacttgggccatgtgtccattgctaaatgaatccctgtagccaggccaatgtcacactgattagccaagtcatcctcagagaaagtgcaggggggatgggggagagagctgccctaccccatgacatggactgagagggaggggtggctccccacaggaaaagggaagtgttcttacgagaaaagacaaaagcatagttttcagcttctttcattctgggacagagaactgaggcacagaggttgacaaggcaggagaacccagttattggatttgggtcccagataggagcttgtcccagagaaagaaaaaaaattgagtctagggtagaaggtgagagcaactatgctgagcttagagtcccttagattcttatgtagcccagatgccacctgcctttcctcagcacaggctaattgtcataggtcttctgagaagcaggccatggggaaagaggttaccacgcaagaggcttattagggagtgttttggaatcaacccctgggggaagggagaggaagggaaagaaaggagcagaactgagcagacggtgaggttgcactgtgacttagtctcaatgggaactccagccaatcccatgggagttctggagctagtataacctttcagtgttgtcctaaggcaaggtgaggaagggaagggggtctttacagtcacaggtggatcaggtatagatgtgtaggctgccctgggaaggagtgtgaccttggacaagacagctgtctctggctgaggcaatcctcatattggtctggcagtggggtgggacttctttgtccctggaggaggatctcagctgcatatcagagtccaccacatggacttgcagcctctgagaatgaggcagcatagcacagtctcaggaatcagactgttgggttcaacgttcacctccaccagttactcaataacctctgtgatcctcagtttccttatttgcaaaatgagaataatgctgttaccccttcacagattgttaaggatgagttcatttaagaaggcatcagacacttagaagagtgactggcacataataaacatttaataagtatttacaaaggagtttagaaatccaggcacaccaaagatattacgaatgtttaagtataactgaatattgtagaaggctgagtcaaggagtcctaccacacagtgtgcagtgtcttactcaaatatctcaatagatgtgtctctttctgcaagtctctcctctagaattctcaaggcagcggattatttgcaccttccccctccttccaccaactacatccagtcctttctacttctctcttcatgacaagcagagtagcttccttcttagcattaaatctggatacctcctgtggctttcatccactctctatctacccttcggggcccaaatagtaaatattttaggctatgtggtctttgttgcaactactcaactttgcccatgcaatgctaaaggttgacagtttctaaatgcatgggtatgagtgtttcaatgaaactttattgataaaaacaggaagtgggctgtattttgcctgcaggccatagtttgctgacctctcctccatttcattgtgttttgaacaaactcttctcaacaaagtcagtcttgacttatagaagaattcttatatcagccactaagaagatactttttccatctcagtatccctattattaaattaaagttaataaagggttaatttttattaattcaagaccatctaacacttaaaccaatggcatggcaactgagccatatcactggaagcctcaatgaggcatcttcaccatccatatctttggatttgggaatataagagatagaggatcctcaacttcaaacattccttttaacaagatcaaatagtgaaattggagagattttatagttttgcttagggtacattgataggaaatgattgatgtggaattcaaaatgaggtatcctaattcttagatgtctaaagacctcagattaacccagattaataaccacagctaatatttttcagtggttactccatgccagtaacttagccttcataatctccttttgtccatgtaatcacccaatgaagttactattatcctccatcttactcagtgggaaaactgagtcttagcaaagccaaggacctggctaaagccagatgattggtagaggaggagctggggtccagagagactgatgtcaaggctcagctggctgactgctgtgccatgttgtgtctgttatgctgttccttctctgtctgagaatatgtcaaagacctttatgcccaattctagccatcctcttattgtcctcatcccagagcactttctgaagcttcttattgcacagggcagctgccctgaagtggctccagcctgaagaacttcccctcaccctacagcagttctgaaaaatgcaacccactgtcgtcacagatcacccaccctggactgatttgtttttcaacagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 467 - DNA, 196840 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatacgtgagtgctcccggcgcgggctgggggacccggggaccagacagacgcgggccggccccgcagcccggaccctgtggccggtccagccccggggtcccgggaggtctccgatgtctgggactcggaccgcccccggggacgagcgggatgctggggaggggcctcggagttgacaccctggggcttccgacggggtctaggtgggcacagcgcggggccccagccccgggcggccacctgctccctggccgcggccgcctggcgcccccttcccgcccgcagcgccctgggggtccctcggagaggctggctggggttcgagctgtcccggcggaccgggcgcccggagggagccaacttcgaccccgccggggcccgggtctggggaggaaccttcagatgcggcttccgcgcagccgtgtctgtaagattaagggattgggaggaagcgttacacttctgcagaaaaaggtagcaattgtgtttgttctttaacacccctgggggattcagaagcggagtttggaatctttttattttttaccttaaagtaaccaattagatcagaagtccggggtcttcttgggttcctctggaatttgccccttcagtgataagcaagtgaagagctcaggagggaagactcggaaggggaaaagttgattttgttttacaccagaggaggggaaaccggaatccctggcgttaggtgtaaaaaggggtgtgtggccgggcgcggtggctcacgcctgtaatcccagcacttttggaggccgaggcgggcggatcacgaggtcaggagtttgagaccagccggaccgacatggtgaaaccccgtctctgctaaaaaatacgaaaattagccgggcgtggtggtaggcgcctgggatcccagctactcaggaggctgaggcaggagaatcgcttgaacccgggaggcggtggttgcaatgagccgagatcgagccactgcactccaacctgggtgacagagcgagactctgtatcaaaaaaaaaaaaaaaaaagggtgtgtgtgtgtgtgtgtgtgtgtaggagaggaagaaaactgtcccaagcacagcgtttcctgccactgtcttgcacaagaggcttcattgttccatagaggctggcggtcactggtcaatcacaggttcgagaagtcgcatgcaccgggtttgatactagagagggcagtattatgggaactttgttctttcccggcataggaattacctcaggcagcctttcatatttatgagccttctttaaataggagaccttggccaaagatagataggtttcttttcagtgggggatgccagatcaatgctttcccccggatttatttattaaccaaaaacctcggagagtcaaggagacttgagtgcaccttacatcgtttcctgatctcggggaagccttaggaaggtcagcctgacttacttaagtggagagaactcacccctggtgattctgatgattccgatgctagatcttgaaaggcttggctccaggagccttgtgttactccctcactggtgctcgagcccccagttcaaatcctaatgtgagtggtaaacctgtgtttcactgtggtaacgttatagaagacccaatcacagtgactataggtaacctgcagtgtaagagaaatgctttattgggcggaagcttctgttctcagttgtgtcgctcagaagtgtgggtccctagacaccttattttcctgctttgtttccttcgagcgaaatggaagagggaagggactaacactcactttgcccgcggtgttcccagttcattccgttcccttctaacactcagtgttaaaaaggagggtcacgttgtggggctaatgtgcagcctctttccatagaaatgagagatggatgggccagcccggctcaccctttggagaatccccccttcccagccggtttctgaccccttcatcttgggagggggacagacagacgtccaattttgatgcttgactccctttctccaggccttcagctgttttctgttatatagatctatataagtgtttgcgtagcttgcatttttaattcccctttgctgtattattacgcttatggcatcacattttcttttaatctaagcggtaaatattctttagtgaacttttccagcatatacattattggataacgtctcgggaatacgagttgtgggataatattatttctgtttttctcattccacctgtgttttttgcagtgtattcatctggctacctcacccatatttacacacagagccattcatctctatcattttaagttcatgtctatggtattaaactaatttgactttttccagaaacagtcatgatctgttttcttgtaattgcgttatcgtccactatgtaggactaaattatatttccttttgctacagaaaaaagagtctgggattgaatactcatatttcctcatggtttccttatgtgacttactttattaaaaaggatagataaatagaccctgttccttcttggtgttcacatagtcagaattcctgggacaaagaaagctttccagctccttctgatgtgtgagggtggctaaaagataaagaagtccttggaaaacattgctgtaggcattttattgtggattaaccctggagagatagcagaggcaaatgagtgagagaacagatgaaggttaggccagggtagccaggtactccacactgtgtgttactggtggtttgggtgtttggatggaccggagccatgcagagatactttgtatttgtaaatggtgccgtgtttgtataccatgaggagtgcttgtgcttatggggtagtgtatgctccctggggtgatgtatgtgctctggggggcgtggggaaaagcgtgtgtgccgtggggtagtgtatgtgctgtggggtagtgtatgctccctagggtgatgtatgtgctgtcgggggcgtgaggtggtgtatgctctctggggtgatgtatgagctgtgggtacggggagaggggacggggtggagagtgtgtgtgccgtggggtggtgtatgtgctgtgggagccatggggtagcgtgtgtgccgtggactggcgtatgtgttgtggagtagtgtatgtgctatggggtagcatatgagccatggggtagtgcatgtgccatgaggtagtttgacctccatgacgtaacactttaaaagcacttctaggccaggcgcggtggctcatgcctgtaatcccagcactttgggaggccgaggtgggtggatcgcctgacatcaggagttcaagaccaacctggccaacatggtgaaaccctgtctctactaaaaatacaaaaattagccgggcatggtggcgggtgcctgtaatcccagctactcagaaggctgaggcaggagaattgcttgagcacagaaggcggaggttgcagtgagctgagatcgcaccattgcactccagcctgggcaacaagagcgaaactcgtctcaaaataaataagagtatttttaacagcatggatggagagcgagttccatttcctcttcagagctgtaaggtgagcaacaccgattcaggtagtttaagttccgagaggaaccagggcagcctcagcgggtagcttagatacttttcttagatactctctgggcagtggcctgaatgctgagtgggagcctccctgcccttcttagccatgtggccttgggcaagtggcttaattccttctgcctcagttttctcctctgagggtaagagcagtactcatttcatagctattgtgagggttgaatgaggtaatctgggtggagagccaagaatggggaagctctcagtccgtttgtcatgcctggctgttaacatagctgagtccctgggtagggttggctggggagagagcaaacctatgggctgccagtgctgctgctcagctacctgtgggtcccggcctgctggcgtcgtgggtcacaggagaggtaaaccgggcaccctgacactgagcatggtgtggagctcaggtaggattcagaaagctttacacgctgtggtaaaacagcccttgatctctgtaaggctgagcatcccggcgtgggcaggatgcttccctccctcttcccttccatgcctctatgtagggcatttgatttttcttcagagttctgtgggtcaagaactcagtcttgttatggtcctataatcttctttcaatgattcagcccagatattccttgttagttttgttcttttgcctgtcagagcttctgcttgtttctaccttaccattcttgcttcttaacattctaagatagaaaacattgaaggatctgaaggatttccttgctgacagtagataattactttcaacacaaactgttataagtttttttctaagagaaaaataaacatttttgcttcccgagaacttgaagcagtgctatattagagtgtgttaaaccttctagaaagtccagctatttatatgcatgcatacatatctgcttcttttatttattaccgaatggtgtataatgtgaacatcagtgttcaactgtgaggttgccccttctgaaagacagacttatttatttaactcagttatgccagcccctgttttaaaattttagaaatgccacataattttggagtttcttttcctaatccaggattagacgatccagtgggaccttgctgttgttcagctgctggagtctacaccacaggagcactaagttaagctgctttagctgccaaggtcttcaggtatttgaaataagtgaatcctgaggcatagaatccaagactaataatctgtctccagcagtgtggtggcaagcctgcagtacagactcgtaaagtgttcataatgaacaaatgtttaaccaggcagctcatcacacgaattcaccaagcacccttcttgtcttcagggcctcgtgtcttccacctggacattctaaagcagtctgcccagatgcataatttcacctttgtgtctacacaaaggttgaatcatttccattgctttttggaaccctgttgaatatctgcttattaggaacaagcatcttgaggtgcttttatttcttgccagggagtgaatttaataacctagagggaaaaaagtttgtattattaggtttggctatagtcagctaaatttctagggataagaacactgtcttcagtttacaattagttaaaactgtgttgaatccatgaataaaaatacatagttgcttaactacacatgaaatcctctatttacagatgtattaaaccctaaaacccaaaatacaaattgttctctggtgcttggagcatatgttcaatagaaacagggttaataaaagattctcaagtcccagacttatcaatgtttttttaaccaagttaaatgctggtaaaaatgctatttatttgcaataaaaatcaatagcaagcaagttttacagagtagaaattcaagaagatcagataagggatgattttctctttcacttggatattattatctgagaagaacaaaatggtacatcccagaggtgccgaggttaggcgtcggagtctgacagacccacattcaagttccgtctcggctgacggctgcgtggccttggcaagttggttgccccctgtacgcttggtgccccatctgcaaggtggggactatgatggtgcccacctggtgggtctgtgcagtgacgggacaggtcacggcgctcgtgcacgctgggtgcccagtgcacggggcgtctttgttgcgcgcatggacctgcggctgcatcaccgtccatgcttctgggcttcttaaggagaccgcctctcaccttgggctttccggaaccttctccccgcactcctcttcacgtggagagtgggtgaccttgccctgctctcccggggagagcggtggtcactggtgggaacgcccctgccacgcccagcagcctttctgcctctgcgcttgcctcctccggttggagcgagtgacccgttctgccgaagtccagtcccgtgtgtgctgcggccccgtctctctccctctctgagtgacactgtctgccctgctgcttgccgtcccgctgttggcaccgctttagaccccatatttcccagcggtcaccgtgctcatttttggcttccagctaccgtttttcttaggttaccccgcgtagctggcccgtccttccttctcctgtctcttctgtgcctaccgcggggggttcccttaccaaggtctccatcacccccaggcccacctccctcgggcccctctctgcccttgccctccacctcagcgactccgtggggcttttgtgatcccagctgcagttagcgagcgcccctgtgtgctcagagacacgccagtgagccgggaaggacagagacccaagtcccatccctctggggcccccttggaatgggggaggcgaacaggaaaccaccacagtgagtgttggggtgccccgcaggcgacggtgctgagaaaaagagagtggggttgggggcagtgcgtgcgcaggctggcgggtgggcgaggcgggtggaggatgcgtggggcgcagtgcttgcgcgcagtgggtggcggggtggacgaggtgagggcctggccaggtgggtgcctgcgtgtccagcctgaggggcggcccacgcagcagcctctgggagccctggggccttccgtgggctgcttcctgtggcgtcctgcgggctggccgcccctcggtgggctccggtgctggcctctgccttccccagggccacggtgggctcctagtggcctttcttccctctccatcaacatccttgtcccaggaagaggcgtccactgcctgctacacgccacccagccgtgttcatttccgtgttccagtgtcacccgtgtgcctagaacgttcctggcacagaaaagccacgcagaaaacagctgctgggccaacaccgagaccccaggtcattagtgttaatcagagtgatgaagaggttgccattggcaattcggaagggaattcagggagagcagccgcagtgccctgtccccagagcctggtgtccagagccagagttccgagggcctcctcatagttttaaaactctttattttatttttattttttatttttgagacagagtctcactgtgttgctcaggctggagtgcagtggcttgatcttggctcactgcatcctctgcctcctaggtgcaagcagttctcttgcctcagactcctgagtagctgggatttgtgccacgacgcccggccagttttttttttttttttttttttttttagtagagatggggtttcaccatattggccaggctggtctcgaactcctgacctcagatgatccgcccacctctgcttcccaaagtgctgggattgcaggtatgtgccaccacgcccagccctgaaactactttcattttaaaacgatgagttcctaagaactagactctgatccctggaaacaacatgccaacctctggcatgcaggacctttgctttccaggcaggcatttcccaattttgttagattctcaagggagcccctgcccctgctaaagttaagactcctgtgctgggacaggcaggctcctctgatgtggctgcacgggcgcactcagcagcctcgatacaatttgaacttcttgctgacatttgaacacagaggacggcacatacatccccacatttccccacttttttggaagtctcgtgactcctggcctgctggtttcccgaggaccgcttctgctggagcgatggccacttggggagggtcggtgctctccactggcctgagttgctgggcccatcactgctgcgtcgaagcctgagaccaccccacccggtcccaaggaggacacaggcttttctggtttggttgagacttgcagagcctaaagaaaactgctgagttgtttttgcgagttacctaatggtgctttagctgctgcatgcttttgtcccatggtgcgtttgtttgtaattcaccacagctgtaattgcagcagagccagagagctttctccttattacatatcctgagaaggaagccctggcagcccgacctgagagagggtgatgtggctcactcatgcagggatgctgggacatcaggctgggagtcaagagatggaattttaggctttctctgccaccttttacctttgtaactagggttgatgtgtgaaccctttgggcagattaatcattagttgcctctttaaaccaatcttttatttatttatctttatttatttatttttgagacaaggtctcactctgtcacccaggctggagtgggtgcagtggcgctatttcggctcagtgcaacctctacctcttgggttcaagtgattctcatgcctcagcctcccaggtagcttggattacaggcgcctgccaccacgcctgtctcattttttaatttgtatttttagtagagacagggttttgctatgttggcaaggctggtctcgaactcctgacctcaaatgatccatctgcctcggcctcccaaagtactggcattacaggtgtcagccaccgcgcctggtctttaaaccaatcctttaaatcttctccattttcaaagtagagtgggaagaaactgatttttctatgaataaagattgtgtaagtcgttctttcaaatgtgatttgtgttcacattcagaaatttgttagtgacatattttcacttatttgcaagtgcctttccttacagtttttctgccactcaactcagatgagttattctcaaggataaagaccacttagatgaatatattttcaaattcttactctgaatgtgtttaagtaaccaccctctaccccgtttggcaaaatgtttcccatttttctgtggtttttattttattttttgtggctttcagaaccagatcacttcttggaaggcatattagaagtttgcagttgagacgataaaataagtcactttttcctgggaggtggtattatgtcacacatcatttggtatcaaaatttcccccggctgtggctgcagagttgaaggacatcagctggctgcgcttggggttggtggtccgttgtgaactctgcaccgtatagtgtgtgtgctttatgtgcaaacgttttaacaaagacaggttgctgcgggcaagaagggttttaacttctgttcgtgttacttctgctgagttggaaggagcacatttcacagatgatgtcattggtggaggccgagcctgccagcaccttgtctgcgtgtgctttggctggacgatggtctacactgggcccctgtgcagcctcctgccggggagcctgtgtcccacctggctctgctctgagccattcatgtcgcctccagtggcagctgtaaaatgaaactcatggcctttgctgtctctcttgtcctgggtggtgaggatcaaatgaacctttattaatggacatgaaaataaccttgtaatttcatacactgaaattacacttttcgtacgcttttcaatgtaacacattgtaaagcgctgtaaaaatatctcaggaaagggctgccaatttttgtcacatctcatgtgacaaaggtaattttttttttttttttggcttggaaagggaacgaaaataagatcatttttcctggtaggaaggtaaaagattttaaagagaaggtttgttacatgtgaaaaaaacgatttgatcaaaggcataattggttgaattatgcattcgacaaggatggaaattacacgttcaacaaagatgtgaagagcgtgcagcctggcaaggcatctctgtccttagcgtgcccacccccaatacgggaagggcaggagaggctggcatgaggcacccgtggtccgtgctgtgggcacctccgggaggcagcctgggacaggcgggtcctgctccagagagagaaggggctgccgtccggcatgtctgggaggctgggtccttccttccccaagggttgtatccacagcccctctcgatcctcacagcagccctgtgaaggagcactgtgccatcctgtgacagggcagccaggtctcattggcactgggtgctgagggtggtgggtgggcgcaggccttgatgcctgactctgaccttgttctccccggcgtggtctgcaccctgtgaagggtgagtgaacgccctcctggcccagttcagccccaggttgtgcctgttgtccccacatcgttaataattatccatagcgtccccttcactcgcagaagcgtccgagcttagacagcaggttccacggccactccaacatgcggtctcaaacccagggcctgcaactcccgccatgtgccccgttctgcttgtcacccgcctcgccctgaggagcctccagctgcttcaggacttgtccctgtgtcacacatccagggcagttgttcactagcatccccgctacccctgaatccatctccacgtgcgtgggcttggacctgcttctctcgcccacttatctgtgtatctctgagtagtgagacttccacgttagcgctgtggggaagaggctgggcttggctcagctgctgagggatcagccgaccccaggtcgctgcggccctttcaggaggacgttggggggcaggagtggccggcggccacctgagaatgggagtggcacccgaatatgtggaatacacagaaattcgagtccgcctgtggccgtctccacggtcctttctaccatgatttctccatgtcccctgcaacagcgacccatcccagccaggagaggagaactctgggaggttgcctggcagttacaagtgtgttaagtattgttgctgcgtgcttatcagttaggctcaggcacagctactaacttccaggcatctcggcagtgtctggcgtttggcagtcaagttgtgtttagttttgacttaaagattaaaaggttatagaatacaggaataatctaccttttgaaggaaaacttgccaagttcgcctgacctttgaaatgccaagaatcccagagatgttgaaggaagtgcccagaggaagatctggtccacagtgggtattcagcacactgatttctttcctataaaaaattatctgtcagggccgggcgcggtggctcatgcctgtaatcgcagcactttgggaggccgaggcgggcggatcacgaggtcgggagatcgagaccatcctggctaacacgatgaaaccccgtctttcctaaaaatacaaaaaaattagctgggcgtggtggcgggcgcctgtagtcccagctactcgggaggctgaggcaggagaatggcgtgaactggggaggcggagcttgcagtgagaggagatcgcgccactgcactccagcctgggcgacagagcaggctgtcaacacatttataaccccagcaatggactgaggtgtgagtaggttccgcgtcgcccttttcctcccagtgttacccccggcactgtgcttgtgtctcggcatcctgtggatggggcctgcggttatccagctggtggttcatgagcacacacatgcctgaggagatggatggagacaggcgttgctagtagcagttcctcctcttgtcacagagtgtgcaaaaacactcttaagtacagcctggtgcgatgggtcaagcctgtaatcccagcactttgggaggccgaggcgggtggatcacctgaggtcaggagttcgagatcagcctggccaatgtggagaaatcctgtctctactacaaatacaaaaattagctgggcatcgtggcgggcacctgtaatcccacctactcgggaggctgaggcaggagaagcgcttgaacccaggaggcagaggttgcagtgagccgagatcgcacctttgctctccagcctgggcaacacagtgagattctgtctcaaaaaaaaaaaaaaaaagaaaccactgtaagtacagacaccgtagcaaccacacggaggccccccgccccgccccccgcgtgttccagtgggaagcagagcctcggaaggcgtgcacacggggggtgcgtgatggtgtctccctctgccctcagatggccaggcctcgggcccgatgtgccagggtgggttcttgtgttccgcgggcttcttgtcccttctgtctgctgtgttgtgcgtgcgtctctctgggtggccttggccgggcttctctctctgtgagacaggcgcatctctcagggctttcttcgttctgctgatatctatcccctctcaggaccactcggtttcaaaagcggtaactaaacttgtctaacacgtgtgcatgagaggaaggcggccagaggcatgggtctgagggctttgcttgaagagcgggcggtgtgcgtgtctcgcagcgcccccacctcggtgtctcagggccttgctgtcttccgcctttttcccagcgtctcaccagcaaagtgagtttatgagaatcatgttaacacacaggcttgatgattgagaaagcagatgctgagaatgtgactatggaatgaataattttcattatgaaaaactgatacattgtttacgacatgattctctgagatgcttgttgctgagattacaaacttaaatggttttattgttatgtaagcacctagcatcttagtgtggagctgaacaggtactgcctgtgtttcagagagctcagccgctgttacagaatactgcaggctgcatggtttacgcaatagaaatttatttcttgtagctcttgaggctggaaatcagatcagggtgtctgcatggtgaggtctggtgaggggccctcctggggggcaggaggctgtgtcctcccagaggcggggagagaactctctctcttcctcctcgtaaccacacaccaatcctgtctgattaggacacagacctcatgatctcatctaatcgtaagtacctcgtaaaggcccaatcttcaggtccaatcacattaggggttagggcttcaatatgagatttttgaggggatcacagttcagcccacagcagtgtcctggtgaccgaggcactatttagatggcgaatattcagacggatcggaaatggcaaagaggacagtcagaaaaacacattacgccttgtctgttgctttatgaaatagatgacagaagcatgttccacgaagtctggaaagacagaacgtaattacttagtgagaatgggttattttttaagttgtggaacaaagttaggtaatttgacccttcttagatgtaacagaccgcagttcccgtggttggttcggatctaaggttctgtgtatttatgtcttctttttgcttttttttttcccactggagaaagctggtaggggagaggtggttggtattaaaacaatgctataacatattgttttggtgtttgcattacaatccaaacacacagcatctggcttattgacaagacagatgttagggtttacatcacaaaacgggattgggcctgtctgctcagtaaactcagaggctgctggatcatgatctggttcttccagtaaatggaattgctttttggagcccatactctgttcacctgcgtgtgtggaggaggacgtcttaccgttgacaaaattggaccgtgctagttggaagttgcacttgaaatgcaggtcagaacaatgggatacgctggtcctgctgtcccaggcgggggagtcacgggagggctcgagtgccacaccacccacacgtcagccaccatgtgggttcccaaggcaagcagtgagttcccaagccagctgtcgtccacctttctgggttagtgtctttttaaataatcaaaggtctttaccatccattaagtactggcccagttgttgtacgcacaactcagaggtgattgtaggttgtgactgctctcagtcggtagttagggtggcctctggcgattgttggaggaattatgggtactttgcgctctctttcactgaaaatgcaaggccaagtggctccagcactcagcagaaaccataactggttttgatgctcttgggagcccaaggccacagtggctgctctgcccccgcgttgtcttatctggaaaggtctgtgggaggcgaggctctgactgcggcgtgcgtctcaggtttgtatctggagcacgtgagagtatgagatgggctgggggtgtccccctccctctgtacttgctcaagtacaggagcagcttgcctgagtctgagatgggctgggggtgtcccccactctctgtacctgctcagggacaggagcagctcacccatttccttcattctttctggctttgttgctcaccattgcctgggaaggaagtggctgcctaaataattaaataatctcctgcttcagagaaaagaggatttcctccaacctattttcagcaaaggattagggacaatgaggtcctgccagtagaatgccatctagattttggtgtggttttccaaggtctcagattgcccacgaagacatggaaatggctttcagacctcagcgggacccctggtgtgggggatgggaggtttgcaggcaaatgggaccacagattctccttcactttccgataaaatgcctcacaaacgtggaataacgggcatctccttttctctctagaaagtgcagtgaggtgacgtgatttcactcagataaatggagacaaaccattaaaatattaggtaaccatcaagtatacacgtgcttttttgttttcagtaataaatgactttggtataaatctgaaagcaacatgtaaaaagaaagctggagcgactgtcatggtggctggagtttccttttgtcctcatttctgatgttatttaactccttttaccatttctcggatgtaatgtggaaacaaaatgtgcaggccctcggcagcgaatgacacgtagagagggaaaccctgggattctcgtaggggagggtgtgtgatgtcctcagcacgcgggggtgctcagcagttgatgttcatcccgcacgcactgagcagctgctgtatgcgctgaagattctgtggggagcaagaggtacaggcgccccagctctcctggagactgggcaaggatggaaggcacatggcatgtagcacacccgctgtgaggaggcgccagggacaaaatgagaagggaagggtgtccgggacggggcatggaggacgggaagccggcagggaccatcagaggacagctccaggcagaggaagccccccaggagggatgagcagaggcctagtctgagacctaagcaggtgtcgactgcccctttagttttcttgctcacaatacagaatgtatgtgttgcttttcaatagtgttttaagcttgtttaatattatacggccaaaggaggaaaatgttacatagtaggtaaatttggatgatttttaacattataaagatgtattgctttattgaacgaatatacaatacattgatttataggtaatttttttattgtggcaaaacatacataaactttaccatcttgtccattgtgaagcgtacagttccatggcgttaaatacactcagtgctgtacgatcatcaccgccaggtacttccagatctttttcatcatcccaaactgaaactgattaggggcaattttaagtagtttctgcatctactattgtgtagcttgctttttgggcaacactcttttttttcatcagtgaaagagatcttaacgggtgaagagaagacattgaaacacaagtgctagttacgtttaaatgcaggatggaccgagataggaggatttttttcttttaaataattggccatagtaaaaggtaaaaaggtaaaaacttgaatgtgaggactcatttgcacttcatattttgcttaatatgctgagagctgcaagagaggaggatctggtgtttcatcttagagcaaatcatacttgatagtaagagacagaaagtcataaaagcgtgatgttcagcaggcaggacatttaaatcatacagctcataatgatgttagttgatggtgttacatggttccatggctttttcctaagtgtgtttataagaaattggaacgaggatgttttctgtggcattttcttccaggagctcggttctgctaattgcttggtttgaataagtgctctctttccagttggtctataacatttcttttactatctaagaaattatgaagaaatagattgattaatttgaaaattacatttaagagtattttcctgtaaaattgttggttctgtgaaaaacaattcctgttatttcttctctaaatacaatgagaattttttttgttcttatattgaaatagctctttgatttcctaaattgctgtgctgctttttaaaggacggcatggtttcagaagctattaggttggtgcaaatgtatttgcggtttttgcattgttgaaatttgctgtttgatattggaatacactcttaaatcaatgtggttatgccacacatcattttaatgtgaatttctcactttatgcttttttgcgactgagttattacttgccgtttaagtttattttagactgtggaaaagacgttagacaaaaagcaaattcgagcgattttcttattcgagttaagaatgggttgtaaagcagtggagacaactcggcaacatcagcaccacattgggcccaggagccgctgggaaccactaaacgagcatacagtgcagtgctgggtcaagaagttttacaggctgggcgtggtggctcacacctgtaatcccagcactttgggaggccgaggcagatggatcacctgaggtcaggcgtttgagaccagcctggccaacatggtgaaaccttgtctctaccaaaaatacataattagccctgtgtggtggcacacgcctgtaatcccacctactcaggaggctgaggcaggagacttgcttgaacccaggagacagaggttgcagtgagctaagatcacaccattgcactccagcctgggcaataagagtgaaattctgtctcaaaaaaaaaaaaaaaaaaagaagaagaagttttgcagaggagacgagggccttgaaggtgaggagcgtagtggccagcctttggaagttgacaacgaccaactgagagcagtcattgaagccgatcctcttaaaactacacgagaagctgctgaagaactcaatgtagccattccacagtcgaccggcatttgacgcaaattaaaaaggtgaaaaagctcggtaagtgggtgcctcatgagctgagcgagaatcaaaaaaattgtgattttgaagtgtcatcttctcttattctacacaacaaaaacaaaccatttctcgatcagattgtaacgtgcgccgaaaagtggatcttatatgacaaccagtgacaaccggctcagtggttggaccgagaagctccaaagcacttcccaaagccaaacttgcaccaaaaaaaggtcctggtcactgtctggtggcctgtgccggtctgatccaccacaactttctgaatctccacaaaaccattacatcttgagaagtatgctcagcaaatccatgagacgctttgaaaactacaacgcctgcagccggcattggtcaacaggaagggcccaattcttctccatgacaaagcccaaccgcacgtcacgcaaccaacacttcaaaagtggaaaaattgggctgcgaagttttgcctcatccgccatattcacctgacctctcaccaaccagctaccacttcaagcatctcgacaacttttacagggaaaacgcttccacaaccagcaggatgcagaaaatgctttccaagagtttgtcgaatcccaaagcctgatttttatgctacaggaataaacaaacttatttctcgttggcaaaaatgtgttgattgtaatggttactattttggttaataaagatgtgtttgagcctagttataatgatttaaaattcacggtccgaaaccgtaattacctttgtaccaacctaagtccccttattattagtaagaaacttaattgtaaaatggagtaattatatattttacatcgttagactcatttaaaaaccgcaagtatagcatgaaattgactagaaaccctatttgtcaggtaatcttcgcagttgacagaaaagtaaaacgtaaaaggagtattaatggcttttccttagcaccctcactcacaattttagttcattaaaaaatgggttgatattgatttctatcaacatgtcacccttgcaaacctcagagcgactgagtctgatggacagtttctcggcttccctggctgtcactcagatgtggcctctcactgtgggccccacgtgggctgcgtgtggccctgtgagttggtcccacccctgcccgacaagcctgtagctttggtcgtcttccaacgagtggctctcccgcctgtgttttgaactcatggagggggagggggagtttgtgcagagaatctaggatcatgtgcatctgattttatgtttttaatgggcctggccaaggaagagagagtgatttggttcctgtcttaacttgaagaccctctggggcaggcacatgttccagggtagactccgggagggatgggtgtgatgtgtctgtagggttccaggcgggaaggggagtgccggaagcaggtctgggagggggaattgggtgtccccagccagcctgtctcaggggcccatgtgggactcttggccagccctctgtgcccctcctggctgtgtcttcaggactaagctctgatttttttttaaatttacccaaattcctttctaaggggtctggggagtcatgccctacaaatcataaattctcatcagatgggttttatttaaccctgtatatcatgacttactttccaatctgactctggcataacaaggaagaaaatcaaaatgttttaccccaaaatatatttccttgtcataccttgaaattgccctgcaaggtcacttgtgggaaaaatccacattctgtagagaatcctcttccccctttgttttccttctttcctttccaggtccaggcaataatcaactaagatccaggcacccttttaagtctgataaaaagcaatttacaacctgccttctctgaagtccgctatctaagagcttcctctgcacaataaaacttggtctccacaatcctttatcttaacctgaacatttcctttctgtcatcccaggtcttcagataaactcaaccaattgtcaaccagaagatgtttaaatttacctatagcctggaagcccctcgctttgagttgtctcgcctttctgaaccaaaccaatgtatttcttaaatgtatttaagtctcatgcctccctaaaatgtataaaaccaagctgcgcccgaccaccttggacacatgttctcaggacatcctgagggttgtgccactcatatttggctcagaataaatctcttcagatattttacagagtttgactcttgttgtcaactgtctgcaaataggagctgcgcccatgagggcatagcccagttaggccgcgctgctccctgctgctgaccagcccctgttggagctgatgctgcccacatcccacagctgagagcaagggtctcaacagcacaggtcctctgcctgcactctgccctggagctgggcatcagccatggtgagggcctggaactgcgtgacacccgggtgtcaggcggccactctcagcatccacattccctcagcatcacggggaggccggctgcagtcgggaatcacgagtgtcatccatgtggtcctccctctttgcagacgtgtgtgtggccgtggtgtttaagttgtgtctgctgccttgggggccctttggaaaggctctttctcacaaagaatgcatcgtgttcgcaaagccagctcatgcctcctaatgtaaactcaaaacccaattcacccctaagcaagtggcccacaccgtgtgtgactggaaaaatcagtgtttcccgacaggatgtgacaaatggggctgtagcagggcagggccgctccccagaaaacaagcgccccaggttttcccttctcctgtaccactgccctggaagagttctacccatgagggcccttggagccatctcgactagaacgttaacaggaaggaaggagcctgcgggagaagacagggctccaggaggcggcggaggcctctgtggtggccaagcaggccccgcagggctgagctgctgggttttcctgggcctgggctgctctctggttccagggaggggttgtaacactcccggcagagctgtctcatggggagggcgttcacaggtggtgagtgtggacagtgaggggaagaccagttccagtctttggcaaatgctgatagtaatgaaaatcattttaaaaatcataacagggcagacaagtcacagctctggttggtcttcacctgccgtcactatcatccctgcagggagagaaggttcggctccctggggctctcccagccccgcgtcatgtgagggggcactagtcacagtgcgggaggcttcagagcggagggcagggcccctgccaaccacccggagccacccacccacccacccaccgctgtttgaagcagggactcggttctcaaagtgccggggtcagaggtcaccagaggctgctgaaatcagggttggagggctggcatgttcgtatttgggggaaggaggcaggatcccaggggacccgtcctgcgtgctgacactttaccacgaggcagctgggccgcgtgcggctcttccgacttttcatcatgcttcctgagccagagccatttaaaaaaaaatgctgaaatttagaaggtagtattcgctctaaaattttgtcgcttaaaaaagtggcttgaagtattcagcaggaaaattgtcccaaattacttgttaaaactaaaagctgggccaggtgtggtgatgcacacctgtggtcccatctacttgagaggccgaggtgggaggatcagatcccctgagcccaggagttcgaagccaacctgggcaacatagcaagaccctgtctctgatacatacgtaaataaaataaaagttaaaactcaaaggggaggaacctgagatccaattttaaatccacctgatgagaaaaaaaaaaaagcagcccagggacgtcaccgtaaacaggcaccgcatccaccaggggtcaggagtcaggtcagggctctggactgggaggggcactgcagggacatcccgtcagcgggcaccgtgcgttgagccaggggtcagggctttggaccgggcaagactctgttttgcttccattttttaagcctctggaagtcctggctgttcagaattccaggcttgaattgctagtgttcccgggactgggaaacagcccggatgtgtggagtaagaggcagctcttggattgctgtgaacgtaggggagcaaggctccacgccctctcccagcctctctgccttctgaatacagcccaggagcctggatgactcactttctggagcacatagataaggagcgggtggaggggagaggccttagttaattaacattcctaggaatctgaggctccttctcccagccctgttgtctgggtagcaacgtgctgaacccagagtgagaacagctggctgcagtgtcaggggcaggaccttttgtcgatgagtttaaaaaacaaagcagaagctgccaggtgcctccttcgcatgttggctcccacgtgttttccccgttctccctccccaccctgagtgacacacgctatgctgcttgaaaatagcacagatgcattttgcttcacggtgaaatgtggccggtagttccccaggagtaaacaatgtggtggtgcccacgggggaagagcagcttaattatgcacccagccccgcatacaaaacgctccctccatggttagaatttgctggggctaagggagtcagggctggttttctccagcagccttggagctaggtggtgtcatttaaatggccctcaaagccctacctggatgtcttcattgtgccacaccagcctttatccaagctcactgggccccacagtgtggctgatagtgagggtctgggggtgggggatcgtgaggtgagggacagcaaccccgtcctgtccttgtctaggcctctgagacaggcccgaaggacaggcttttctctctactgtgggtgatggtcccggctggtcagctagcgtccacagcccctcgactccctgcgcagagcccctctcactggaccggcgtcagtgccccacagagactggaaacctgtttccaaggtgtggctctatggccggaccacagtcggtgaggtgagggccagttccagccagggtgccacctctgccttttcttatgtccactggaaaaaataaagagggtgtttgtcatcccctgtcttttgggactcggggttcagtgcaggccaggggaggttgtgtctctggtgtttgctgaacacaaagcgtatgaaagtggtaacacctcggaggtgagggctttctttttatagcagccatgctggaactcagtgtctgaggagacctagagtatttgtttgaatgtttgaaagagacgtatctggttaatgtgagcagaggcttggaaatttagagcacgctcgactgtatttcagtagacttatgacagcagctacacatccatccattttagcattctcagagtattctaaaacatggagggctgggcacggtggctcacacctggaatcccagcactttgggaggctgaggcaggcggatcacaaggtcaggagtttgagaccggcctggccaacatggtgaaaccccgtctctactaaaaatacaaaaatttgctgggcatggtggtgggcgcctgtaatcccagctactcaggaggctgagacaggagaattgcttgaacctgggaggcggaggttgcagtgagccaagatcatgccattgcactttagcctgggtgacagagcaagactccgtctctaaaaaaaataaataaaaacatggagttcacaaagtggcatgaataatcatgaaacgaagtgacttcaaagtgtaatggttctcatgcatgtaagaattcatgttattaaacaagtataaataaaaaaattgtgcactgcataagtgacagatagttttgtagtatttgttaaagtgccatcatagccgcctgtgaaagaggtctcagtaggtgtctgattcttgtttaatgccacagcttctgagactccatttgtttcaggcagagtggacatttcactcgcggtttaatttgcgggaagatcacattctggccgtttaatcttctgatgacagacagctaactgttgataaggataaaatgaaaccagacatcggtttgcatgtgtccagttgaggggaaaaaggccgaggatgctgtcaggacgcaggcaggcaacctatttaggatggggagtagcagttcagagggtgtagcttccattcctggccccagcctcccttccactcctcccacccctgatcccagcctcccttccattcttcccaccccagatcccacgcctcccttcccacccagcttccattcctggccccagtctcccttccactcccccccacccctgatcccacacctccctttcactcccccgacccctgatcccacgcctcccttccactcccccgacccctggtcccagcctcccttccactccccgcacccctgatcccacaactcccttccactcctcccacccggcttcctttcctggccccacgtctactggaattccactcctcccagctgtcttgcacccgctctctttccccttgttttctcttttccttcccaattagcaccgattttccttccccgattagcacctcccgctgccgctccagctgtgttctccatctcctggtctggggtgttccgctgcagccacaggaccccactgtgggaacccacgtctctgcagggaaatgtttacggtgactttcctatgtgtgtggctggctcgtcagggagcggtgtggaggagacctgaaggacagcccttccccttccctttctccctcctcactccccgaaccctgcccagctctgggcctccccagggctgaggagaggtggcgtctccactcctgacctggaggcccgtctggcttctggctccagccccctctgctgccttctttgtgtgtctgtgatggaatacgcgttctgcgtgatgagactgttatggagacgcaagagaatgtgaaggtgaagcttctcgaccttgggctggagcgggtggggtgctgagagcaccgagagccccttgccacctcggcttctggcaggtcagtgaggccactgtggatcaggcttttaagatcatgggaaaacacacataacaaacatgcaacatcttgtctagatttatgtgcacagttcagtgctttagcacgttcaccttgtgtcaccatcaccactgcccccccgcagaacttccgcttcttcccaaactgaaactccgtcccgcttaaattctctcctccttcccccttcccgtagaccctggcagccccattcaactttctgtctctaggtatttgtcagctcaaatgagtgactcacacaggatttgtccttttgtgaccagctcatttcactcagcacaaagtccacaagggtccctgtgttgtagcctgtatgactccgccgttcctttgcatggatataccacgttttgctcacacattcacctgttgaaggacacttgggttgtttcctgcggcagcttttcctgaccgaaagcttctcaaaaggactagccccctcaggtgccccaaactcgattgcagaagactgtgttgtcacctgcctgcttctacagagaggcaccaacctggggtgacatgtgcactcttggctttgtagtgtcctggcccatccccggtacctggccaatcccctacacctggcccacctccccacacctggccgatccccccacacctggcccacctccccacacctggcccacctccccacacctggcccacctccccacacctggcccatcccccacacctggcccatccccgtacctggcccatcccctgcacctggccgatccccacccttcacttggctgaggcccccccccacctgcctgatcctccccacctggctgatcctccctacctggctgatccccccacctggtcacactgcccctcctccccagagggttgcccctctgtatttacagttgattaaaatcttactttctctgggaattctttacagattaatcttcttccaaagacaaccctaacctgtgccttttcagcagttgtgctattttgcaggacgaattcgcacctgtttctgtgttgctctgtgatcattcccaagtggcttgggcttggagccctgttgctcacacctctgggggccggggaaggtgtttgccagagagacagagtgtatggccttgagggcaccttctccttagaaatccgatcccattcctttccccttctcccactaagggctctctgagggatggtagtggctgggtgtggaattgggttttgctttgctttctctccccagcagctctgggcaggctggctctgtgggggcctgggggtggctcctgcctggactttgagaattggagaggcttggagctcattctcagtggagttcccggtggctgctccgtcttctgagcctggtcctctggccttctgcagatgctgggagccacagcaccctgtgatagaccttttgccagagctcccatgagaagcatccaccgtggtggggccaagtccctaggccccaggcattccccatctggtgggaagtgggggctttagcaagtcgcatctctctctgcccctcctggtgagctctgctccgacagctgtgggaacccgtgggaatgcccacctaggtgcgtgtggcctggcgtctccccagattcacttcctagtttttcacttcacgtggcccagacactcagaaggaaccaccaacccagtggtctgtggtggctctgggggcctgtgggggccaccacctctagtctcctggtaggcatcccctccgcctctgggaggacgggagccgggacagagggggcaaggaggcctcctgggactggggcgttccccaccttccactgtgccggtcttcatgcagggccagagcctggctcggggctgggtttgcactgagccaggtcctgactctcacccatgtcttgggcacgtcgatggggccgggccgctggagagggtgtgagagcaggttcctccccaggtctcagccagtgacggggcccatcctggacttgggggctctgcgtgagtggggcagtggcagctcctgcagggcccaggtggggtgtgggtaggtcggggaggctgctggcctcccagcctccctcaatttctgcgttctaaagatggctatgtgcaaaataaaggtgaaatgatggggcagtactggatcaggtggacatccgggagctggaggcccgtgcactttccctgggacgggcagaggcttgtggtgtccacccacagacgcagacccactggcctgcagggcccatagaggctgttgttggccctggtgatgagtgggggacacgagtatgttctgaaatgagggggaggcttctgttgtgaccttgaccaggaagagaaagagaagccaggaggagagcagacacgcttccgccttgaggacggcacttgttcaagtgtaaagaacggaacaatcgggacaaaatttaaaatgcaaatatggtctcatttatttgtaataaaaggctgctggaaagtaggtgcaggagtggcccaggttagcataatactttttctcctaatcacatccaacttgtttttctactcttatttcagaacatgcccccccgccatcccaggagaagcagcagctctctgcctccttgactgagctccattacctccaagctgagagggttgttcaagagggcgtgtgggattcttttgaaaacacatttttagaaagcacccttttaacaactgaacatgatttggttgaaaataaacatccccgggtactcttgtggtacatgtttatgattttgatgcttctggtctgaatgtacaaccttcacattgtacattacaaacactactgtcaagtttatagattttcattttatttgctaattcatttttcagttctctgcactgcttgtaaatcaggcaaacctgataaactgtctaaacatatgatgatactgaattgattaagttatggtcgtaggtgagaaaacagtacatgttgtgtgatgccattccgaaaaagtttcaaacacacatctgtgcattagaaatgattgccacgtggccaggcacggcggctcacgcctgtaaccccagcactttgggagaccgaggtgggtggatcacctgaggtcaggagtttgagaccagcctgaccaacatggtgaaaccccatctctactaaaaatacaaaaattagctgagcgtggtggtgcatgcctgtaatcccagctactcgggagccgagtcaggagaatcacttgaacccaggaggcagaggttgcagtgagccaagattgcaccactgcactgcagcctgagtgacaagagggaaactccatctcaaaaaattaataaataaataaatgattgccaccgccccctgccccccaccccgccaaggcgtgaacaggagttgtctctccccctttgctgtgtgatagtctttttgcttgaatttattttgcttttccgtaaagaacactcattgcttttaccattggataaaaagcataaaaacaatatagatattaaaagcacctggatttttttgacgctttaacaattttaaatttcttttcaggtgacaatgttcaactctgctttttgtttgtgctcatgaaattttatttgttagccagccaaagccaagtgtttccagttaaatttacaactcttctgtctgttccaaacacagcctaagcaagaagacaactgtgccgcctgccgcaagtttcatgtgaaatacccccagagggcagccgcctccgctgggggtcctccctccgaggtgtgtgcggtggggatgggaacccgcagaggcagcacccagctacttgccacttaggttcttctaactgccctcgagagattgtcactgggtcctggatccctgggtttggattagcagtcggaccagggtgggcttgcaggctgcacttttttttttttttttgagactgagtttcattcttgtcacccaggctggagggcaatagcacgatcttggctcactgcaacctccgcctcccaggttcaagggattctcttgcctcagcttcctgagtagctgggattacagttgcacgccaacactcccagctaatttttttttcttttgtatttttagtagagatggggttttaccatgttggccaggctggtctcgaacgtctgacctccggctatccacccgccttgccctcccaaagtgccgggattacaggcgtgagccactgcacctggcctgcttttgaaataggacgtagggattgagggagggttaggatttcaacgatggctttaacagaagaagagaagatgctgaaagtccggcttatttgaactgtgtgtgtgtgactttgaattgcgtcaaatgccatcttggtgaacagttggaggggccctcaggatgccctgtgacgcgcaggtgtgactttgaatcgcgtcaaagaccgtcttggtgaatagtcaggggccctcaggatgccctgtgacgcgcaggcaggaaattatgatggtgtgtttcaggtatgcaaactgcaccagaggcaacacaaaagcaagtcaatataaaaagactcaatgccttgcatgcctttgttatattctcacgtaatcttcaatcttctgttcatgactttgttttgaaacacttttaaaatgtaagattaattaacttgtaggctgtgggaataatcccatttgccgaatcaaaataatgtatccttgattccaactgtcagaagacaaaattacaaaacatttagttatagatctgattggattttaattacaattccttaacggggcagcgtccgttctacataatgagagctcccactgggcaatggcagaacagtcagttttgtaaggtggaagcaaggaaacagaataagaagctgatggtgaacttcaggttacttcaggttacttcaggttacttctttgtagagggtaaagcagaggggactttgtcacttgctgactcaggtcaacagaatctcctatttttgagaaaaaccggtctgttttgggacctgtcacttctttaaagttccattttggtgacgtggcattgagcaggagcaactccattcctgtttggtctggtctgttggggcctagtgctggagctcagtccaaaacaacagtctcccataatttaaaaaaaagtatttccatttcatttctggaaattcagcctaagaaagtcatatcccaagtgcccacaatcatatcagaatgttctttgcagcagtatctgttgtagcaatgaaaacatctcaagtctgtggataagggattgatcaaatacattaatgaccattctgttaatggaaagaccaaagtctgtaaactattttaaagaggtttattctgagcctgtctaagtgactgtgggctggggaaacagagtctgagaaggtgcacctgaggcagtcagatcacagtttgggtttgtatattttagggagacaggactcacaggcaaagccacaaatcggtacatggaaggtatacattggtttagcccagaaaggtgggatttcttgaaacgggtgtcacaggccataggtggagtcggagattcttcagtgtgcgattggttaaagcagtaaagctttgttgaaagcctggagccagtggaagggagtgtttagatgaggaaacccacgcccgacgcgcagggtcagggttacctgtggggtgcgttcaccttcgtctgctgtggccgcgggtcccgtgagcctgggttgaggcaaagaggttgtggagaccggggctttatcacgcagatgaagcctctgggtagagtctgtttgttttttttttaatttttttgagacggagtctcgctctgtcgccaggctggagtacagtggcatgatctcagctcactgcaacctctgcctcctaggttcaagcgattctcctgcctcagcctcctgagtagctgggactacaggtgtgcaccaccacgcccggctaatttttgtattttttgtagagatggggtttcaccgtgttggccaggctggtctcgatctcttaaccttgtgatccacctgccttggcctctcaaagtgctgagattagtcttccgtgatgtctactttgacatcagtacctaaaatccaaatgggaggggccaggcgtgttcaacctcccttatgtcgtggccgagaattcagttttgaagttgcctctggggttcctttggccaagaggggtccattctgttagtgggggccgagctggaatttggctcttgaagtcagaaggtgaaccacaggccacagtccgcagcctccaggagctactgccgccagctgagggccacagttgctgatcgggaaagggtgtatgtaaggccagtcctctgtccggtcagaagtggaagggtctgggttgtaaatcagagttagggtccgattgctcctctcattagggagttggagtgtgtttttttcttgtagccttaggaatttaggaagttgctggaaccctctgccccgcaggtaacttttgtttccttagcgttagggtccatcttagtcaagaaaactgtttgttttggtctcttagatcacaaatgttacgggaaagaagcaggaaggaaggctgaaaagagaaaacgtacctttgctcactaagcactaagaacaaagaggctttgttctcttgcgtgtgcatttggatatgtcgagggaagccgggtactccaggcagggcccagaggtggtgtcaccctggcagcacactgcagcggtcactgctgaagacacagaaacagcttcccgtgttcttggacttgacatcaaagatggaacggggatgtggcctgggaacgaggaacgtggaagccaggagtgaggaagtgggagggtcccacaagacagcagaagggcctggggttagtcccggggtcagttgtgggacgctggtgctccctctcctccacggctgggcttcccggggtcatgaacctgtctcctgcccgcctcttctggcccccagcgaatgacattgcatataactgcttttttagagtgttaagaaaaaggctgtttcccaaattcagattagtatgagcaaaaagaaggagaccacataggagccaggatgtgagggcgaccaggaggttcaccaggccgtcagcaccgcagccgctggaggcgccaagtgcaggccgtggcagacaaggggaggccggcacactgcccaccatgggagctgctgggtcattttaacttaaatatcctggggccacataaccctgcaatctgaaggacgctacagtttgcaaaaaccaaactctgtatcagtgaagggtccaactcacaatatttgaggagatttattctgagccaaatatgagtgaccatggcctgtcacacagtcctcaggaggtcctaagaacaggtgccaaagtggtcggggcacagcttggttttatacattttagggagacatgagacatcaatcattgtacaatggttttgcccagaaatgcaggacagctgtaagtgggccggcggggggtagggggaccggggaggagggtgggcccggggagaggggggcggccaggggagagggtttccaggttataggtagatttaaattttttctaatggacagttggttgaaagacttatcagtagaaaggaatgtctgggttggggtaaagaggttgtggagacagggctttatcagggtagcgagtttcagggagaatgaatagattgtaaatgtttctcagtggacttcaggtctgtgccagcgtttgtgctggtcagcctttcctgaattccaaaaggaaggagggggtgaggaggcatccgagtcccatcagggccggaagcaggttttcaggataactttggagtgcccttggcggagaggagggctccattcagatgggtgagggcccttcaaatttacttttggtttacatacgtaaaatactttagaaagatttattctgagacaatatgagtggccgtggcttggaaaaacacaaacctgagaaccatcgaggaagtggtccaaggtggtggggctggttggatgttacacatttcagggaggcaggagtcataggaaagacgtaaatcaatgagtggaaggtcgacgtggctcagccggaaaggcaggatgacttgaagtaaagtaggcggattcagaaatgctttacttttttctttttaagtattttttttcagagattctttaatttgcagttgattaaaggagtaaggttctatctaaaacttggagtcaacagaaaggaatgtttaagataaggaggccctgtcagagtcagccacagggtcaaagagccctgtttagcaggtctgacgcccgcaggcgggacttaaccctcatctgtaatggcactgggccctgtttataatttggcatcttagtgccacagagtctggttttttttcttcgatcctgtgagcgtgggttgaggtaaagaggttgtggagaccagggctttatcacgcagatgatgtcttattggtgtcttattgccacagagttccccacctccccccgccctcttgtcattcaggctgttgtgcagtggcgcgatctcggctcactgcaccctccgcctgccgggttcaggctattctcctgcttcagcctcttgagtagctgggattacaggcacacaccaccacacctgactaacttttgtacttttagtagagacggggtttcacaatgtcggccaggctggtctcaaactcctaacctcaggtgatccgcctgccttgtcctccccaagtgctgggattacaggcgtgagccaccgtgcctggccagagtgtattctgtttgttttatgatctctgtattgatgttaatgctggtcagttgtgtctaaaccccaaaagggagggggtagaaggaggtatgtgtaacctctgtcatggctgggagctcagtttttaagatttttctggggttcccttgaccaagaagggatccattcagtcggaaggggcttaggattttatttttagtttgcaagttgaatgtctaggcagctgactgaaggttatttgatgaagccaaatgcctggatgctcccaaagtgtgcatatctggtcctctgtctcgcccgaaacccggaggccctcagggcctgtggattcccgggaacgctcgtgtcacacgggctcgggtggcatgtgcggggacataccacttaatgtacatacaagcctgtcgtgtggcgcagttgatctcaacttttaaataaagaagatgagcatcgccccctccatcatccctgcccacacctctcaccagcgcccactgcctgggtgtggaccagcccctatcgtccccatcgcccccttcgcccccttctcccccatcgcccccttcaccccctttgcccctattgcccccttctcccccatcgccctcttcgcccccatcggcaccatcgccccattccgacactgcatgccctgagttcaagtggaccccacaggttatgggctctgtcccccaagacggcctgcttcagacacagctacaagtctcagggaccacctacacttctgagcacctgccataaacgtcagggagggccctgtgactcagggttgacgatttactggaaggactcgcggaactcaggaggtcactgtgctgaagacaaggggcttatgatggtgggagcaatgtgatgggtccactgggagccccctgtccccgtggagctgtcacgtggccctcctccagaaccgtgtatgtgcggcagccaggattcgtgcatccagagtttcatcagagtctcatcactgcttgggggtctcatcacactattggccaagagattgagttcagtctccagtgtctcccttctccccacaggtcagaggtcaggctggggatggaagctgcagccctgtcctggggtgaggccggcccccccccaggaagctgtttggggcccatcttgagtctcctcattagcataaactcaggtgtggtccacaggggctcttggtgagcaacagaaacactcctgccatgtgggaaattccaagggtcctgaagcatgctgggcaccggaacagaggccaggtgtgttcctcattccaccacggagccagggtctgacccaagtgtttctgtttccaaaggtgatctgccttcctctgctccagccacccctgcggccatgcctgtggtcccctgtgtgggctgggctgtggccttggacctggtccccacgtcattttcttctcccttggggtggattgtctgtgggcccggtgtgggaccaacagctgatggccgacgcctcttgccgtaggttgccggccatgcatacctgggggaagacttgaactccatccctctgtcaaccctgttctgagtcacaagagacactgcaaaccccccttgtgggagctgactcaggctcgggctgggctcaaggcagtggggtggggacagacaggtaaacctgtgatcatgatacgatgtggacctcccatggccaaggtgaatcccaaatgctttgggagcagagtgaccaaaagaagacccctggggagcagacgaggtatgggcagaggcatcaccccctccactctctctgctctcagccctcaccagcccactgcccgggcatgcaccagcctccttcgcccccatcgcctggcccctgccacctgggtttctcagccgctgccttcactcacccctccccacaccagtctggagtgataggctgcgtctgcacgcggctggctctgcctaggtgcccaggagtgactggcacaagtgtgtgctctatgtgcttaatgcctctaacgaccaagtgtgggaagcttttctcgtgtgtagtaatgaaatagctcagatgtaagcagaacagatgcaccagccctcccatgccccagccagtgagtgtgtggctacagctgtggctgcaaagtccccatccctggagttccttggacaggagaagcttctatttgtggaggatgactaaggacaacgtccctgagggtggcctgttggttacaggaagctgaggtttggaacagatccctgcgtgcaggtgagaacgatagaaatgggtgaaggaggctgagagagactcaggagcccctccccggcagctgaggtgacgagggtgcccctgaaggacgccctcagagcaaggtgctggggagggggcgggaagcggtggccctggggcctgctcaccgcacctctgtgccaagcaagctttgtgcttttagttttcaccgactctgcttctgtaaacgcagctggtgtctagggagtcacaatcggtccttgaaaagaggaggcttctctgaagggaatagtgtgtgtcaccaggaggtgtatgccggggatggggcacggcgtgcgtgcagggagaggggccagggggcacagtgtgcatgcaaagagaaggcccagggggcactgcatgcgtgcagggagaggagccagggaggaagcacgtgcgtgcagggagaggggccagagggcacagtctgtgtgcagggagaggggctgggggcacagcgtgcatgcaaagagaaggcctggggggcactgcatgcgtgcagggagaggggctgtggggaaacacagtctgcatgcagggagaggggccatggggcaccatctgtgtgcagggagaatggccgggggcagttgataggtgctgggggacaggcctaaaggcagttgtacttccgagagcttttcccggcagattcccagatctgcaggtgaatgaggtgaaggagcccaaaggggccgtctggatggcagctcctgaccttctccatctgtgctgctgccatgtcctctctaatgctccagccgggggtgctgcagatgctgggggacagaaaacagagccaatcaaatgcctggctttgcaaactggaaaaaaaagtccattgcttttgcaatttgaagggctcacaggagcagaaaattagtggtgaagagtgttataaaattattggatacagtgccttaacctgtaaacttgaagctgaaagtgtgccatgagaaaggtacaagcagaataaaaaatgcaccacctaatgctactgtaggtcctctgaataaataattgtaaagacatcttccttgggacatggataatagggaaaaatctcacagaaaactggggacattgcaaattttttttctcatatacagctttacaattcttgcatagcttatgcgaatttcttactataacttggggttgtaggtaatagtaaatctgaacgctgctgctgctgcttctttttttttcttgagacagattgttgctctgtcgcccaggctggagtgcagcagcacaatctgggctcactgcaatctccgcctcccagggtcaagcgattcttctgcctcagtctcccaagtagctgggattacaggcatgtgccaccatgcctggctaattttgtatttttagtagagatggggtttcaccatgttggccaggctggtctcaaactcctgacctcaggtgatctgcccgccttggcctcccaaagtgctgggattagaggcgtgagccactgtgccctactgaacgctgtttctagtgataacttgctgctctatttttagcaagtttactatatttatttactttattcaaccagcaattactgagaatctgctataggcaggttctgggaacacaggaaacaaagcaaacaacagaaataagaattggtcttttcctggtaggaatttaaaatctaatgggagcagcagcagtctctttccaaaaaaaaaaaagataaatgccacaggtgactctagagaacactgcttttgttctttgcacgtgaaggaaccaggctgcctgaggtgtagaggctccacacaccatgcagggcccgcacaggccccatttggcaggcagaggtagtccctgcccgttttcttgagggctggtggctgcctgggaaattcacctgacaccagattgaaatgcagatcggctttcatctgtttctggagctaaactctggcttcgtgcagcctgccacgcagctcggggactccggcgctgggcgaggaactcggctccaggtgcatcttgttaaaggctgagccccatttctcacatgcgttgcggaatcgaattctccgtgtaactcagaactcagagtgaatgagagatcgatacatgtagggttccagcaagggccgtgtctggtgagcaggggaaaaacacccctttttcatagaccagggactggcaacctttttctgaaaagggcagatagtgaatgttgtaggcttatggggccttgaggtctgtgcacctgctcacatctgccattgtagcaggaaaaaggccacagagaaaatggaatgagtgagtgtggctggtgccagttagcttaatttacaaagccagtcactgacctttacccagataactggactggtggacccaacatggaggggccatgagaccatgcggcccacctccctgtgttacctgtatgtaccacgttgtcagtatccacgcgtggatgggccatgagactgcggcccgcctccctgtgttacctgtatgtaccacgttgtcagtgtccacgtgtggaggggccatgagactgtgcggcccggctccctgtgttacctgtatgtaccacgttgtcagtatccacacgtggaggggccgtgagaccgtgcagcccgcttccctgtgttacctgtatgtaccgcgttatcagtatccacgcgtggagggggccgtgagactgtgtggcccgcctccctgtgttacctgtatgtaccgcgttgtcactatccactcgtgggggggccgtgagaccgtgcggcccgcctccctgtgttacctgtatgtaccgctttgtcagtatccacgcgtggaggggccgtgagactgcggcccgcctccctgtgttacctgcatgtaccgccttattagtattcatggacctttaactacaaatattctgtgatcgcttacctctgctgttcctcttctccttgtctatcttgatatagttatggactgattggatttatggaatggatatacaaacagttcaaaattcaaagctaagagaagaatacacagtggctgctgacctctgctagcggcttccctcctgggggtggcccactgcaaactccaccgtggccctggtgcatgtgacaagcaaatgcagtgatcagaggcttgactaaagcaggttttcacgttggcgacatttaggatggttagttttttaacacatttaaagcaaaggctttgttctctgttgagagtccaggaaaggatcctgacgtcttaagaatctgagtgacaaaatcggtgaacctgagtgaaaatttagaattggaagacatttctgttagcgtatcatcccgggtgctcctggacgcaggactctccacacgtctggttggcggtcagctcatttatgattgagcctgaccttatgacaggccacctcgttaacgattggatgttgtttttatcactctttactacgtttgctttcccacccctgctgtttccatgggtttatccgactctgcccactgaggcagcacagtcccctcgccttagcattgcgggcccagagtatctaacgcgtccgagtgcgaacagtgtcagaaggcactgaggcagcgcggttcccacctcggcattgcaggcccagagtatctaacgcgtctgcgtgtgaacagtgtcggaaggcactgaggcagcgcagtccccaccttggcattgcaggcccggagtgtcttactcatccgagtgtgaacaatgttggaaggcactgaggcagcacagtccccccacctcggcattgcggacctggagcatgtaacacgtctgagtgtgaacagcgtcagaaggcactgccgcagcgctcctgctatttttagcgtcctgctatctttagctgatagagtcaggccacggtgaggccagcaggccgctgaatctcacggaggcttcagaagttgtgatgctggcccctcagcttgcgggaactcttcgaggaaaaaaacgcgcaaactgttaatgttgtcagtgattaatctgattgaagcaaacggggaatggttgttacttttaaatggctcctgacaatggtttggccagggcttagatgtaacagtagtacttacttcttcaatagccaaagcttgaacttaggaaaatgggcagcataatttttagttacagatttgggagctggaagggtgcagagtctcatctctgtgtccatgctaagtgcagcttctcatgatggtggaggacgagtttcttcatgggaaataaaagagcccgtgggaacccttcgcagcggcccacatagaccacggaccacatgggagccgtggggctggtgacctggaagggggcatcctgcagtcacatggcaagggcgacctcggaggagtccaatctgccaggacatgggcagccgcagagcttctgtaccggaggcgatgctgttatctttatttgtgtggatctgtgattcatgtggatctgtgaagcctcatggaggccggaggacgggcattgatgagggaaggtgaggctggcaaattcctggcatggaacagtttgttctcaaagagccagctgagcccacagcagttttgtaatctggaacctcgtggctggcgtgtgatgtgatgaactcccctgctgatgcgtgaataactcctgacacatccctgttctctagtaacacggtgctaggcatgggacacacagccgcttcccaggaaactccacagcgtgagcaccgggtgcctgcgcaggtgcgggaggatggggctcccgtgcggagtctgcgcagggcctcctggtgaaattgcgcccttctggacacactgctgggtccatcacatgagcctaccatggcagatcatatatttgtaaatgaaccttaaaaggtgaggtttttaggctttcagatatttggggggaaagggtagaaaactgcccccaggaggcctgaatgaatcaagtcgtgctgcagagcagggaggattttcggaattagatgccgctgtgacggcagcaggtcggtggcagggtgggaggaagtgtgtcttcgggcagcactttctcatgggacaggtgttctttccgtagacagtctatttatttatttattttttgagacggagtcttgctaagttacccaggctggagtgctgtggcgcgatctctgctcatttgaacctctgcctcctgggctcaagtgattctcctgcctcagcctcctgagtagctgggattacaggtgcccacaccacgcccagataatttttgtatttgtagtagagacagggtttcaccatgttggccaggctggtctggaactcctgacctccagtgatccaccctcctcagcctccaaaatgctccagtgatccgcctgccttagcctcccaaagtgctgggattacaggcatgagctactgtgtccggcctcctatacagtctttcttagataaaacaggaagggttagctttattactaaagaaaacagattagctttattactaaagaaaacagaaatgccatctaagcagaaatagaaactaagtatcagaactcccttgatgactgcgccacacacttcattcccactccattcccagccaggagtccacagcccaagtctcattccagccagctgaggttctgtagttgataatcaattgcacggcactcactagttttctgttttatttatgagtaaagttttaagtgtgacgatgtaagtgaaaattcaagagtgggaactggatgtgaatcaactcattgcctatcgatggcccagcaggtactgctgtccccaaggaaggtgcgggaggagacagtaggtgtcacttatgttcatggctgtcccacgaggcctgtcacgtcctatcctatgagatccatcacatcttatcctgtgagacttacaacaacctatgctacgaacatatcacatcctatccttcaaaaaatatcccatcttgccctacaagcctctaggagcaggtgcagaagtgcacgtgaggaagggagcagtggcctgaggggtgcatgggacagtggcagtcccagcagtgtgtggggtaaacctactagatggtggagaaatgggggcgggggggggcaggtggcccatgttccggtgtgggaaggcatagcgtgcgggcactggcctccccaggtgagacagtggcccgcagcggcatcctgtgcatacctgcacctacggtgttgtgcagtgagtaaaaggctccggcatgagttcggtcctgtcgggaagttggttgggagttttagggacgtggcaataactgcgtcccaagcagctcctccattcagggcccgtgacggtctggagtcggaggagccacagaccaccttctggttcctccattgcactcaggtgggcaactttaaacgtttctaagttaaaacaaagtctaacttactgtagaatagaatgaaaacttggcataaaaatgtaagaatatatacaaaaactaaaagaaataatgtgttgtagtgggtgattagaggtcctgggccagtgagtctctctctccccatcctcttctttcctactccctgcttccctctctctccagctgtgtctctctccatctctctctctccagctctgtctctctccagctccatctctctccagctccatctctctccagctgcatctctctgcattttctcttctggcctttgtggttaaacttgagaataaaaataaaagcacttacaaatttattttatgaccatatctgcctctagtttgtttgtttgtttatttattttgagacagagtctcgctttgttgcccaggccggagtggagtggtgcgatctcggctcactgcaacctccccctcccaggttcaagcgattcttacgcctcatcctcccgagtatctgggactgcaggcgcacgccaccatgcctggctagtttttatatttttttgtcgagatggggtttcgccatgttggccaggctggtcttgaactcccgacctcaggtgattcacctgcctcggcctcccaaggtgctgtgattacaggtgtgagtcactgcacctggcctctgcctctagtttaattagtgcttatgttttatttaggtggcaggtgttgaattacagttttgattaaaacccttctattttagagttggagcaatagacacaggtttacaagttatttatataaagatttctgtacatgtttttgttctaaaaatacatttcattgttaaattgggcattagaagcacaatgatacatttcttaaagaactaattatacaggcaaacactattaatatttaacaaggcatctgtttttctccttgtccatgcgcttccccacaaaagcagagaggggaagctgaatatggcttgggggcacacggcgcggggcacagcatctccactttacttaaagatgagcagtgggtggaggattcaggcgcactgagcatgcagggcactcacaggatcctgctgtgcagatgcaggatccgcagtggggacaggatggataggactgtagagcttgtttgatgcagagattctaggcaggaatgtgaaagcctcaggtgttaagtttcactgtttttactaacactggatattaacaatttaaaacacctttgacatattttcatttgtatttcatgtcttgatggttaagagttgagctgttgagcctagttctattgttgactggctttctgctgaaaagctaacaggttaaatggtttgttaaatccagaaccttcgaggtaggcccacattatcacattaaactcacaagtgtggatcacaagtgaaggagtattgcacagaatgttttttcctttccttataaaatgcattagtctatgcaaatacaactttaggggaaaaataatatatttaaaatatattaagtttatcctatatttatatattttggtttctgttttgtctaagagctccagaaattccttgctgacattgtccaagtcagtggacagccaaatctcatttttctgactcaattctgtgattcttatcttcagagctgcttggattatttagcagtggttctctctttccttttctttccaatcttaaattagcagttctatgtttcactgatcggtcatttgtcaaacaaatactcattgagtttctattaataccattacaccaggcttttgtgttacttagttatcgagaaaatgatttcatccgggttaatgagctaaaatggcacagtagacagtgagccaccaggagagtgagtgctcctgggcttcactaactgtgctgcttccagctgataatgaggttttgtttgagaaactaagccctctggacgtggcctcccagcaggatggacatgcgagctcagctgttcccctgcttggcttttaattggtgctgggatgaggcaggtgcagggggcgggggtgaggggcagggaaagaaccttgaaatacttgagaaaagggcctttcctgcaacttggttaagaaaccgttgcaagcacaataatattgggctgaaagaggttggtcttcatggaattttagtaacccaaagtttaagacaggagtgaaatttcttgtctttatttctaatttgcaaactggaaaagtgagtctgggcagaaattgggtttctagtgcctgtcagtgacctcagccatcaaccgccgaggaactgcaggctgcccggagagtcaaaccctgactgtatcggactcaaaaaataaatatcagtgacaaatgcagacttcgaaaatgtgacccaatgctttcacactcctgtacttttcataaattagtggttttcaaagtggatagcaatatgaatatttctctttttcagtgatactgtttttctcgacaccacaaaactatcctataccctgtacttggctcacctgccctcatagccgcacttgggggggatcactatggtgcctggtggggtggcaggtgcctcctcctgaggcagcaaccccaaaaggtaagcatggttctgcccacgcccccatttccagcaggccttgtcagcggtaggaccatgaataccgactggtgagggggagtgccaggagacagagaagacggctgcccactggggcttctagtctcccttccaggaaggatttgaagtagctgacacaattaaacacaacataaaagaggactttttttaaaaaaagaaaaaagctgagaaaaatgttagcagacgtctgggatggatttagctgtgcattttctggcagtgaaggtaaaaaaggaaatctccatctgggtctaataaaaggcactccatagatacactggggaaaataaactttttcattcaagggagaattaattatagaaggacactgggaaatctaaataccataaacgggttttgctaacgtttcaagaatgttgagattgagtttttttccgttaaataaaaagttgatttctttgagtgccccgaaagccgggcattgcatggcagcccagcgatatagccttccgcgtggctgatggaggctgtttccaattgcctgagctcacacaagggcaggaattacagaacccacagccgtgatttctacgggtttgtcaacagaactccttctcaaagcattttatttgtataaatttataaattccaagtcttaacattacttagtatgaattcagtgaaaaagtaagactttagtgaacacaaaatctgaagcgagaggttgtgatgcttgctggagtcaatctgttcatttccaggttctgttttggttgcattgtgtagaggaaaccttcactcgcgcagataagaagtgctaagtggtcacagggcttagaatcctgcaccgtgcatcctcaaatagctccagaaccttgacagaggcattacagagttgaactcaccagccattgcgtgattcacctaacatcgcttacatttctcagtgtaaagttaagcagcgcaccaaacctttcagcagtcgctaagttgggctcagcactaaggagcacctgacttttccgaggtgcatccataagtcccatggtccgtgtgctcctccatgcctccgtgtgcgcatgctctgctgccgggccacctcccgcacctccgtctgcacatgcccagagcctatgcagagcctccgtatgcgcatgctcagagcaggtgcagggcctcctcccgtgcctttgtgttcgcgtgcccagagcaggtgcagagtccctttgaccttgcttaaggagcgcacaggtgtggaccatggtgccaggatgcgggttgtgagggtagcatggacagagggtgagaactcgagccctgatccaaccacactgtttgaacttgaccctatcacttagcacatgttttaactttggcacgttatctattttttcttagcttcagtttgcttgtctctaaaacggggattatatggcaccttcatgggagttgcatgatgatcaataagaaacccatatagagctgctaaatagtgtctgacacataggaacacacacaaaaaatcagctaactttataggaaaagatgttatcactgtgttttctggggtggcctggagctttcctcctgcggtagcatctcagcaacgaagcgttatcttacatgtgcttcacgttctacaatataagggggcctgagccactgatgctgttcagccaggagcaccaggcaggtgaaagagaagagagctgctgatgagaagtcctgatctttctcctcccagttaaattaaaatgtgtgttgtttccagcatgccagaattatatttataatacaattgagtgtgcaggttttctatattgagtacattttggaaatctgtcccctagtggcatgcatctaatgcactgtccattttaggcagagatgacaacaaacaaatatattactaaacttacattgagactaaaattaaaattaaactagatttaaattaaaaacttttgtgcttcaaaggacgccattatgaaattgaaaagaaaatccacaggacgggagagaggattggcagagcgcaggtctggtcagggatttgtatccagggcagcgttggaaggctgtggagctgtgggaacccatatgtgcctctggtgggagcattcaaaaccatttcagaaaactgtttggcagtttccagtaaatatatgctcctggaaacaacccacatgtctatcaacagtagaaaaaaacaaaaataaatcgtgaaatgttcacattaaataaaatgaacaaacaacatgggtgacttttgacagcctaaacaaggaaaagaagccagacaggaagagtatgttataagattcattgatgtgaggttcaaagctgggcactcctgggggatggaggcagaggtcaaagtggatgagaccttggcaggtgggagggtccacagtcacaacaggggcatctcagatgctggtgatgctgtgtttcttggccctgatgacagtggttacccaggtgaaggctgagccgcacacccagggcaggttaggcactttgtgagcaagttatccttcggtgaaatgttcgttaaaacagatcatgactcatgtggcgttaaatattacagggaaacctccagaagggatgggcttccagggacggtttggcaagggccagctatgctgagctgccgtggtcataaagaccagaaggagaggagggaaggggctgggctgaggaacagcatgggcagaggccccaagacaggactcagcttggctgtgtctgaggagccatcagacagggaggtcaccgagggcctcgtctgccttctccttttatctgagtggatggaaacctcggagggttttgagaagaggacaaaacaagcaggctgtaaggttacatggtcactctggtttgtattgagaataactgcagtgggctcagtggtgagctcaggtggaagcagctccgtgtcttggattgacaaacacaggtttgctgccagtgctacagcggtcagcctggtcctgtgcctccataactggcctctctgctttttcgtggtgcagggaaatgctgcttccggaagcccattcatagtctcctctgtagcctggaattgacccttgaagagttcacaggtcctctccctcagcccttttacttttttctgaacccaagctatggtcagaagcactcaacattcccatatctgttcagcgccggcttcccaaagctctttgcctcgggttgaaatagctccaacttgggctgggcacagtggcttatgcctataatcctagcactttgggaggctgaggcaggcagatcatttgaggtcagaagtttgagaccagcctggccaaacatggtgaaaccccgtctctactaaaaatacaaaaattagccaggtgtgttggtgggtgcctgtaatcccagctactcgggaggctgaggcaggagaattgcttgcacccaggaagcagaggttgcagtgaattgagatcacgccacggcactccaacctggacgacaagagtgaaacaccgtctcaaaaagaaaagaaaagaaatagctccaacttaaagtgttagcgactcagaaaagtatttacccctctgctcgtagagtattgaacgaacctgagattattgccataatttactgcaaataggaaaagcaatgtgagctggggacattttgcttgtttcttctcaccagagcagtgccgcagataagccgactggcttcatgcagcgcagagctcctttaagcattgtgggacaggtggatctgccaagcaggagctttctgtgctggcccaaggcaatgtggctcagttctagcccctctgaccctattctgctgccggtatgcccccacccacctgcctccccgtccccctcctcctcccccaggtcccagccgtcagccgtgttgttttgctcactgtgggatgactgttcccatagaggctgtttctcctgccccgcccctacagagcctcccttctcgtgtcccactgtgagtctaggttggcccatgcagttctggggcctgctgtatgtcttcttcccctagtgaaacagcagattccttggggtaggaagtggcgtctcacctgtctcacctactccatggagcctagcagaggactaagtatactgcagatacttaggacttactttattgagttgactgcagaaaacacagggacaaatcatggtgaccttggattaggcgatcttttcttagatatggtataaaaagcataagcaaccaaagaaaaagatagataaattggactagattaaaattaaagacttttgttcctcaaaggacaccattacgaaagtgaaaagaaaatccacagaatgggagagaagattggcagagagtggctctggtcaggcatttgcatccagaagacacaaagaactctgtcaactcataacaaaatgatgctctaatctaaccgtgggcaaaagattttaattggtgttttaccaaggaggaatacaaagggccagccaatgaatgaaaagatggtcaacattatttgcatttatttacattagagaaatgcaaataaaaactttatgcttcatacccactaagagggctgtaataaaaaagacagacaatgaagaggtgttaaggaggatgtagaggagttggaagtcttgtgcattgctggtttggaatgtaaaatggtgaagctgctcggaaacacttggcaattcctcgaaatacaggaatatgaagagttaccaatatgccctgcaattccacgcctaaatatgtcctcaaagcattgaaaacacgcgtccacacggaaactttcacacagatgttcttgtgttcttggcagcattattcatcatagccaaagagcggaagcatctcagatgcccatcagtagacgaatgggtaaacaatgtgatttatccttacaatggagtagtattcagccacaaaaaggaacgaagtactgatttatgtacaccatgaatgaactttgaaagcatgatgctaagtgaaggaagctagaaataaaaggccacacgttgtatgattctatttatgtgacatgtccagaactggcaaatttgtagggacagaaagtagattaatggttggcaggggctgggggagggggcgtgggagcgactgtaggtcttgtgccttcttgggatgatgaaaatgctctagaattagatggtggtgacgattgtgcaattctgtaaatgaactaaaaaaccactgaattgtacattgtaaagggtgaattttatagcatgtgaattctctctctctctctctctctctatatatatatatatatatatagatatctatatgtatatatatttttttgagacggagtctcgctctgttgcccaggctggagtggaatggtgctatctcggctcattgcaacctcatcccaggttcaagtgattctcctgcctcagcctcctgagtagctgggattactggcgcaccaccacacccggctaattttgtatttttagtagagacagggtttcgccatgttggccaggctggtcttgaactcctgacctcaggtgatccacccacctcagcctcccaaagtgctgggattccaggcatgagctactgtctcggcccaaatctttcttaagttgtgtctggcctttggcagaaatagccacaaagccagggtaggaacgttttactcttcaagtgatgatggcatccgataaccttttagagggaggttttaaaatgcaacgtagcccagggctccagaaaaagacctgcacggagaagagagggctttgtagctctcagcagacaaggcgtgctgcccagggagctcagttttcactgtaactgggttgcactgtcaccaccggtctcctccccacagatcccacgggaggacttcctgttgtgtaacatccagagaagcttctggaagctggggagctctggctgtgcaggaaagatctagctgttttgttgcagaaggcgctcgccatcagggtcccgggtcgttgacccacccacttccgctgctgacgtcatgctgcgctcagcgttattcagggcggaattttcactcgtcagaaatggatttgggagcattttaaaatagtgcgttttcagaatttttgtggttgtctgagaaccaaacaagcaaggcacagcacgggtctgaatcacttacatgggccttgtttgcttgtttaggtcagtgtttctaatactttatatttctaatgtaaagccaaagaaagccacaaagagatttaagatgtgggtggaagtgctctgtttgctgtgtctgtgtttccacagagctttatgtttttttgggaggctggggactggggaggtgagggacatggagctgtagtcgggagggttgggcagccacactgggggtggagaaggtggcccggtccctgcggggctgtggggcaggagctgtagtcgggagggttgggcagccacaccagggatggagaaggtggcctggtccctgcggggctgtggggcagaagctgtagtcgggagggttgggcagccacactggggtggagaaggtggcccggtccctgcggggctgtggggcagatgaactctctgggggcacctgtcatggtggagggcagagaacaatggtccagcaccattaccctggcctgggctgctccaggctgcccgttgcatcagcggtggagggtggaggcactagccaactggggcaggccatagcctcactgtgggctggagactccgtccctgtgctgatctgggacaggtgggctgcagggagactcaggggcccgtgctccttagtcgtttgttcccgccaagccacctctctctctgcccatattcagtggatgccggctgtttttgtttgtggctctctctgcactgttttccatctgcctctgtgcatcagggcctttaatgttttaccgggtattttgagcctcacagtgactgttccgggtccaggggagtaaagagtgctctgctccctgtggaggtgtacttctcttcccccaaagattgctcctcttccccagagcgctcctcttcctccatagactgctccccttccccacggaagagcgctccccttccccacggaagagtggttcccccaccacagaagagtggtccccctccccacagaagagtgctccccttcccccacaggggagtgctccccctccccacagtgcgcttttctcacgtgtcctaagtatgggtggtgcggggtgaacgcattgtccacagggagcagccacccctggaggcaaacaggaacactcattcttgatctagatggtgccaggttgaaaggaggtttttaaaataagtgcaggctcatgtagagatggctgctgcctggcctgatgttgcatgggaaatgcagcatgggaacccttggggggtgggggagacacctcctgtggaagggggtgctgtcctgtcacctcccatgtcgagttgcgcctgagacactagtgtctgtgctgctcagcatgtggtcccacggaggagcccctgcgggcgctggtctctgtgggagactggggtgtgagcacgcggtgtcacaggtcgtgtgtggggggacttatgacaggtgctgtctgatttcgtagtctggatgttcattagcattaatttcaggcactggacgaccaaaagtgagaaaagggaaaacctgagaatttgctcagctgtgtaaaaatgatgccacttacgataattctgcgaagctaccgcttatgccagctacctgtggagcgcaacatcggcttcctgaggcagtctcagcctgctccattttatttcacttagatggtatcccccgtgtgtgacggccggccttcgccctgtgcctccccgcagtgtggctggatctcagggggctcggacacgtgctcagactgaaggtcagaaagagcattttccattctgacccctgacaatggcaagactttccacaggtagacacctgtttttccaatccttactgtgtagcgagactttctgcagatagacacctgtttttccttattgtgtacgtgggcagaggggagaggcactcactcaagaatttcctagatgtctgatacagaactcaccctgtgaatctagttaggtttctaagcatcagtagcacagtgtatgacagcacatgtgccagcagacctcacctgtgcagagggttctatggagaggcgaagtcgttagcctgctgtggcttctctggggaagattcagactggcagacagttgctccagtgccctcatccttgatctgcttactccctgtgatgaacacatgtattttgtgagatgtctgccacatgggtgggaaacgtgtattttcaccatcgtgaaaaaaatatggctgtattcaatagcattgctggaaaatagaatgggctgagggaggtttttaagggtgtggttattgggcagatgttgcaggttcctgctacagtgtgatgatctgtgcagatgttgtaggttcctgctagcactgacggcataggcaggtgttgtatgttcctgcaggttcctgctagcactgatggcataggcaggtgttgtaggttcctgctacagtgtgtgataacctgtgcagatgttgtaggttcctgctagcgttgacggcataggcaggtgttgtaggttcctgctacagtgtgatgacctgtgtagatgctgtaggttcctgctagcactgacggcataggcaggtgttgtaggttcctgctagagtgtgataacctgtgcgatgttgcaggttcctgctagcactgacagcataggcaggtgttgtaggttcctgctagagttgacggcttaggcagatgtaggttcctttgagctcaggaatgtaacacagtaagcttaaggtaacctatacagcttcaggaaaagaggattggttgtttatttcctgtggtctcagggtgtccttccctggagtttagtataggcccatccaccatccagaggcttcattttgaatttggggagtttgctaagaactttaaccaggtctgaaggaaaaaggggagttgtgcatttgtaaagtatttggttttgattgaaccaacagtgcaagttacaggttaagccagttttcaggttagaatatttcctgctggtatggacgtggtcattttagtcatcatactatgacggctgagctgcgtgtccagctgcggtgagtgggccacttgcctctttcacgtaaggaaggcttcctcttcacgcatttgtcagtggtcaagaaagttaaaacaagaaggcaggagaatgtcgctgtcctcccagcacccggtttgggacggtctgggagggtgtgatggagtgcagtgttctgtatgttgatgtgtgttgacggatttctctgtcctcccggcacccggcttgggacggtctgggagggtgtgatggagtatggtgttctgtatattgatgtgtgttgatggatttttctttcctcccggcacccggcttcggatggtctgggagggtgtgatggagtgcagtgttctgtatgttgatgtgtgttgatggatttctctgagtggcgatttcagggatgcttatttctgtccagtgaatctcagacatggggagcctaatcttcacatttggtgactctccctggcagcttctcacgtgaaagctgattgttagctgctggtgcctccctccccggccctctgctcaccacctgccctcacgggtgagccgctgcacttctcgggctcgttggcctgcagtcagctctcggctcggtgctgtggaggtgttttgcttttgccaggaaagtgcatcctccacaccttccctcctggtcgactcttagtcacccggctggtgtgtaaagcacagagtgctctgaacagtgttccaagtgtgtcccaagttaaaacgttgtggttagccaactccagttcaaattccttccctacttcatgtaagatatgtgagctctccagcctcaatttcttcaactgggaaatgaaaataacagggatgtccctttcaaacaatggtgagttttaaatgtgatcatacatctgggagtcttaaaatagtacgtggcacacagtgattcatcagaaaatgtgaggattttactgatggggtaattgggcactggatagctaagacttactagtttcgagataagttagtagcataataataataactattactattatttgagacggagtcttactctgttgctgaggctggagtgcagtggtgccatctcggctcactgcaatctccgcttcctgggttcaagcaattctcctgcctcagcctcccaagtagctgagactacaggcgcccgctaccacgcctggctaatttttgtatttttagtagagacagggtttcaccatgttggccaggctggtcttgaactcctgacctcaggtgattcacccacctgggcctcccaaagtgtggggattacaggcgtgagccaccgccccagcccataatcagaattagaatgtagctatttaaaattttatcccagtgttttaaagtatgtttagagtattagtaccacccaaataaataatcattcattcttttattcagttggtaataatgtgaatgtttagtgagtactaagctcttactgtgtaccctagtatgaagagaataaaaggatgcacaataaatatacatcccctaatcagagacagtttcaaattttagtttataatttgtaggtgttcctcctcacagctatatattagaatcatatgagaatgagtgaggaaagccaaaaaaacaaaaggatcatcgagaagcataaaacaaaaagattaggagcggtgagaggcaggacccaggcttggtattgttatgttttaaataattttctaaagttttgaattgtaaaaaaagcatgcatggaactgaccatcatagccatgttaagtgtacagttcagcagtattgagcacctccacattgtcgtgcagcggaactccagaaattctccgtcttgcaaaactcagcctctgggccgttaaactaggtgtccccacctcccctcccccaggccctggtgaccaccgttctgctttctctgtctgtgattttgaccactttagatacgtcatttcagtggactcatcctgtgtcgttttgtggcggaatcacgttctgttgtgtgtatacaccacgtttttcttgtccgttcacctgtgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccgggtaactggggttccggctccccacgtcctccccgggtaactggggttccggttccccacgtcctcaccgggtaactggggttccggctccccgcgtcctccccgggtaactggggctctggttccccacgtcctcaccggcacttggcactgtctagtgttttggtagcagccatcctgctccgtgtaggtagtatctcattgtggggttttgttgttgttttttagagacagcacctcgctctcttacccaggctggagtgcagtggcacaaccatacctcactgcagcttcgacctcctgggctcaagcgatcctcccacctcagtctccccagtagctgggatcacaggcgtgcaccaccatgcctggctaattaaaaaaaaaaaaaaaaaaagacaactttttttggagagggagggtctcattaggttgctcaggctggtattgaactcaagtgatcctcctacgttgacctccctaagtgctgggattacagctgtgagctgctgtgcctggcctcattgtggttttaatttgagcacttttcatctccttattagaccttcttgctacaaatgtctattgaggttctttgcctattttaaaatcgggtaattgatttttttctgtcattggcttgcattggcatagtttttttttttttaacttcctaagtggtactgacgtgtggccggggtgaaaacctctggcctaggtatggaacaggtagagggtgttaccgagatgatgagtaggagtgttcagaaggtggtagggatcacccgtctgctccggagggatcgcttgttgagatgagatgaacgctgcacttgtggacatgcagacgtcttgcaaacaagtggggtcaggatgtggtactcaggtgcagcctcagggccagggtggattcgggagcgtaagggaagggactgttgctggaaagaaaagtaggtattgaaggaggtggaggcaaaacagtccctgcacctctccacctgcagactcagctgccgccactgcagcctcccggagcttggcgtccacgggtaaggacctccctcagcttgtgggcaacatgtcttcagccagcgtgccaagaaactgcaaaggcaaaatagtgtttttggcagtgtttcaaagaaacagagagtgcattatgtgcacattcaatagccctactgtagctttttagcaaattacaaaaagtaacacagggcctggtatggtggctcatgcttgtaatccctgcactttgggaggccaaggccggcggatcacttgaggtcaggagttcgagaccggcctggccaacatggggaaaccccatctctactaaaagtacaaaaattagccaggcattgtggtgcacgcctgtaatcccagctactcgggaggctgaggcaggagaattgcttgaacctgggaggcggtggttgcagtgttcagagatcacgccattgcactccattcggacggacagagtgtaagactccatctcaaaaaaaaaacaaaacaaaacgaaggaacacaggattgtatgcagaaagaaagggtaaggcaaaattgaagggatgggatgaatttgagcatccctcattccaaaatcccaaatccaaaatgcccaaaaatctgaaacttttcaagcaccagcatgatgccacaagtggaaaattccattcataagctgttgacacaaactttcatgcataaaattatttaaaatattgtataaaattaccatcaggctgtgtgtatgaggtgtgtgtgaaacacaaatgaattttgtgtttagatttgggtctcatcacaaggtatctcatgatgcatatgcaaatgtcccaaaatccaaagcacatctggtcccaagcattttggataagggctactcaacctgtatttatagacagaagctagaaggcatttgtgggactctcaaactaagatgggtcttcattaccttctaactttggcgatcatgtagtagatatatttattctgagaaacaatcataaatataaatgcatttctttcatttctttttattgagatgggatcttgctctgttgtgcaggctggagagcaatagcatgatctcagcttactgcagcctccgcctcctgggctcaagcaatcctcccatctcagcctccagagtagctgagactgtaggtatgcgctcccacacccagccaatttttgtattctttgtagagacagggttctgctctgtcacccaggctggtctcagactcctggactcatgcgatccattcgccgaggcctccaaaagtgctgggattacaagcgtgagccaccacgcccggcctgaatgcaatttttacattatagtcatttatgcttcttcctgttaatccgaaataagcaattgtgtttttgctagccagctacagagataatgtaaaaaatgttttaaaaccatattatcaagcagaaaatggtgcttgtagatcaatatcttcaacagtttcccattaaaatttcagtatgtggtcggatctaactactggaggagcttcgaggtcatgccagtgtccttaacactcgcgtttgttaaagacagccactgccgccctttgcggctatgtgcctcacctcttccacatcacggagcacacacagaatgttgccatttgagccatgcactgggtcacgggtgggctgggcgtcagggtgcccacagctggagtgacctacagagcccagctctgctggggccccagggcaggtggctgcagcgtccccagcggcctccctggcgtgccacagcatgaggctgtctgctctggtggatgccgtgggccatggatgcgcctccatctccgcacagtgcagccggtctagctccctaagccgccaggctctgtgcccaactcaagcagcagccaagtggagagagctggaatgtgtcatccctggtcccagccttctatttcttaatagaaattaagaacttctgccacgcttaaaagaataagggaaactttcatttcgtagcattctaacttttattttaaaagtctttcactattgaatgactttcctgaattaactacattctcaaaaatattcccagcattggtcaaaggcttaaggaattttttactaaaagttgcaacttgttgagtattaaaagtcttacagataaaaataagcaaaggagatttacagaactcagaaaagaagagaagacacagatatgctttggggaaagtactgaacctagatattaatcagagaaaagctgggaacgttgattcctaggaatgtggatactgtgttaggaagagaaagggaaggagagtctccatcctcccacgtggggacacgtctgctgaaggatgcggggttgaatccccttcagcctctcgtgaatttctgtcttagggaaggagaatctccatcctcccacgtggggacacgcctgctgaaggatgcggggttgaatccccttcagcctctcgtgaatttctgtcttagggaaggagagtctccatcctcccatgtggggacacgcctgctgaaggacgcggggttgaatcccccttcagcctctcgtgaatttctgtcttagggaaggagagtctccatcctcccacgtggggacatgcctgctgaaggaagcggggttgaatcccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcggggttgagtccccttcagcctctcgtgaatttctgtcttagggaaggagagtctccatcctcccacgtggggacacgcctgctgaaggatgcgggtttgaatccccttcagcctctcgtgaatttctgtcttagggaaggagagtctccatcctcccacgtggggacacgcctgctgaaggacgcggggttgaatccctcttcagcctctcgtgaatttctgtcttagggaaggagagtctccatcctcccacgtggggacacgcctgctgaaggatgcgggtttgaatccccttcagcctctcgtgaatttctgtcttagggaaggagagtctccatcctcccacgtggggacacgcctgctgaaggacgcggggttgaatcccccttcagcctctcgtgaatttctcagtctttcagtccactttgctcactagtgtttactgcactaggttttcgtttgggagaataacaaagcctcctttgagttcggggaaggttggaagtggaagctgcctgtttgggagagatgacttctgacctcttctgggtcacgtagcttccccctgcctttttataacaagtagaattgttatgataattaccgtcatcatgatatttttatttatcattatcctctccttcatcaaacatttatagagcaattaattctgtgccattctaacttcatcggtgtaatgtcatcatgaggtacaatagcattattattcccactttagagatgggaattgaggcataacacgtagacggctgcccactgtggaggagctgaaccttggcggtggggccgcagggtctctctgctccctgtgggaccgcccttttctcactgttgtgagcagggctgttcctttccagcaagatgaacaccggtgtaagcgcgtcttcgtgtccttccatggatgtttgtagaggtggagctactgtgtcgaaaggcatgtgtcttggtattgtttgtttactgctaaattgccaccgtacgtttttcttccatgaacagcctgcgaatacaccctgccatttgtttattgggctgttcatttttttctcttgatttgtgagagctctttttatattaaataaattagcccttgccaggtacagtgtggctgatgcctgtaaacccagcactttgggaggctgagttgggtggattgtttgaggccagcaatttgagaccagcctggccaacatggtgaaaccccatctctattaaaaatacaaaaattagccggatgtggtgacgcgcacctgtaatcccagctactagggaggctgaggcatgagaatcacttgaacccggaaggtggaggttgcagtgagccgagatcgcaccagtgcacttcagcctgggcgacagtgaggctccatctcaaaaacaaaacaaaacaaaacaaaaaaaaaaacagacattggccctttgactgatatgcatactgcagataatcccccccccctttttttgagacagggtcttactctgtcacccaggctggagtgcagtgctgtgatcccgcgtcactgcagcctggttccagtgattctcccgcctcagagtgctgggactacaggcatcagccactgtgactggcctcccagtttttcatttgtcttttgacattatggtatacacatacacacatgcgtgtgtgtaaatacacaaatatatatgtcattgcatctttgtaaataacgatgtggctaagtcgttcatcttttcctgagccctggagtgccccatgcttttaagggaccccttccccctttccacaggtataagcctttcaggaattggtctagtattggtcattcatttgttaggaaattaggatgtttcctttcttagggcctctcactgtaaaccctgtgtctgattatgtcataaatggcctgcctcgtttcaaggtgggggacgtctggcagcagagaagtcacaacagtgacggcggctgtgtcaggtggggatgtacatggagaagaaaatggggcaggacagtggggctcggggccgggaggagggcagcctttttctgtgctgcagtcaggaaggcctcctgcgaggacctgtttgagcacaggagtgacatgcagcgccattcccaaagtctcctgggttcccgggggtggagagtgcagctcaggagaatcctcccggcgggcgcccctgtgtggagcgggtacccctgtgcctggtgggcgcccctgtgcggagcgggctgtgagggacgggggctcctctttctgtccccacccccagcctgctgccatcgtcttcagcactgaatacgcgtccgtctgacgggttgtgtatttctatgtgagaaaattaatgaggaattttactgagagttgttctgaccatacaaacttaattgccctttcagtggaatgaaccacacatttctacaacacagaataccgtaatgtagtttaatagcctggaatagcagtaggatgccaagaatttactttccaccgccgataaccacagtgtccttgctggccatcctacaattgctaaagagaatgtagttgtcagtgtagcatcgggactttccaggaaagtcagccaggatgcacccacctgggagtggcttccgcctggcctccagcagctgccgaaggagccgtgtcctttggagttaatggagggactggctgtgtattcaatcacatatgctacatggtctacacatcctgcccacaggtgagttaacaggtcatcttttcatctttcactctaagtcttggggcaggaggtagaagtcagtgacatcaggcccagggtaaatgagtcagtgttcccaatgacatatacggtggcttacagttaccccggcccagacttttttctctctgtccctccgtccctttgtacctgcgtgttatgtggatggcgtgcatgtgtctgcacagctgcgtgatgttcccctgtggactcaacctcccccgcccctggccgccccacatcatggacagctgggctccaatcttctgcttttataaatagtgctgcagatgccttgtgagtacatcagctatatttctgcgaggacagctttgggatcgctttggagaagggagatttctgagaaggggggtacgtttgcggtttgctctgtcagtgccgtaggaggatgcctgttctccacctacctcgccagcagcctgcgctgcccggcttgccagcttctgggcctgcctaccgctgctggatgagatgccacgtcctgttgtggttttatcttgtacttctcctgctaacaggcaggttgagaatctttttatgtgtttaagtccatttgctgttcttttctcttttttgaaaaagaacagcttgtttatatcttttgcccatctttcatttgggttgtgtcttgaggagctctttatatacttctttattcttgatatttttgtgtgcctgattcctgacatatttattattaataataatggagcaataaagtgagtcacataaaaaaaataatggagacagtgattcccaggccaagagacacataaattatttaactgcagtcaaacaggcttatgttagaagcgctttttccaaaatgcaatgtagagttatttaaatttaaaaacatgctgaggaattaaagaaagaagccatctatgttcttcctggggcatcatttgagctcattacgtggacaccgctgcctctgaagctggttctgccacacgcctgacaggccgatcacagcctgaccttgaccaggcagcatccagggcgtcgctgtctcaccgtggtccccagtgttttgggattgaggaggggttcggcttcactctcttcagcgcctggggccttcatcctgagccgcagttggagccacggtccctgctgctgagatgtgagaaaggcctgcgctggggtctgggaaattcgttttctcgcagaaggcagagaaggccgtggaataacagggccgggttctcactggcgggactgttcacctctgcaatctgccccttagtgcctcggctgattcttggtctttggagacctggtccccagtcccacctctgcatatgcctccagataacgctcgccatgtttggggtgtatgagcatgctccttgcgttcactgtcacccaggcatccctcccagcggccctgtgaggcaggtgccaccccacagccctgctctcccgccgaggaaactgagtactgggctaattcacctgccaaagctgcatgcttggaaagtggtgcttagagccaggcaggactcactgcggctcctgtgctccacgctgcccccccgagaggcagaactttctcaggccaccttcagggcctcctggagaggttgagccccagactcctgggaagctgttcccccacgttctgtactccactcacaggtggacccatcgcctccaaagcctgtgggtctcattggctggaatgtctcacactgcagggcacctggccacccaggggcgtgtcacaaatgcgggcggggggcagggctccaccccacaagcctgctcaggaggcctctccacgatccacaatcgaccacctgtccatggagctccgggaatgctggcccggccccactgcagggcttccccagccctcctagacaccctgcacttgcccctcccgagcgcgtgtgcctgacctgctccgcggtgggcgcagagctcctgccgagggctggatggcgcggacctgggcatcgtggcctctgcagtgccagctgtgccctagtagccagggcgccgtcgtcagtccatggctcaggaggaccactgtgggccgatgaaatgcgactgtggacgaggaaattgtactttccgaacattttcacgtgtccccaaacagttacttttcttttgatttttttcaaccatttaaggacgtaaaagcattctcagttcatggaccacacagacaggctgcaggctgcacgtggactgggggcgggtctgtgggcctctgcttcacaggtcagaggtcgctgggttttcgtgtcttctgctttccattgcacagtcccaccctctccttggatcctagaactctgcccagcttggacagtctctctacacccagagaccggttttccgcttcttgtctgcgtcccttgtagcagtcacccacagggcgcttgccagaggacggccccgaactgcctatgggatccctccaggtcctctcagagcctccgtttcttgcatgtaaaattgacacaagaagagcctccctgcaggactgcagccaaggttagccagaaccatttccagtcacggaaccgtcactcagagcagctcccagaaccatttccaatcatggaagcgtcactcagagcggctcctagaaccatttccagtcagggaagcatcaatcagagcggctcccagaaccatttccggtcacggaaccatcactcagagcggctcccagaaccatttccggtcacggaagcggcactcagagcggctcccagaaccatttccggtcacggaagcggcactcagagcggctcccagaaccatttcccgtcacggaagcggcactcagagcggctcccagaaccatttccggtcacggaagcggcactcagagcggctcccagaaccatttcccgtcacggaagcggcactcagagcggctcccagaaccatttccggtcacggaagcggcactcagagcggctcccagaaccatttccggtcacggaaacggcactcagagcggctcccagaaccatttccggtcacggaagcgtcactcagagcagattctagaatcatttccagtcatggaagcattacttagagcagcgtaaatttcttagcaaccctggtgttgacatatgttgattataatgatatccttacaacattaaactacaaagccaaaaccaaaatacaaattaaataaaacttagtctgtgaaacaggttagattccaggcagggtctacgattctggctggctgtgcgaatcgacctctgaccccaaataactaagggtcatgtccatcgttgcggtgccttcaggaaaggggaaagtgtttttcctggcagttctttctctctagaccctgcaggccacctctctcacctgcgtgttgggcttcaggatcagggtccccttccagtccaggagaggcacctgtatctgccttctgcccagagtgtgtgtgcttgttgagtctgaccactcactggggcgctctcttggtaacagggtccctgtcacctagaccttacctcccagggtctagcggatggcggggcaggtgggggacggcacgaaaaacagcagacacgatttcagaccgctggtggcggctgagctcaggtgggcctcacctggagagcctggacggtgtcagaggtgcttcttggctggtggctgaggcttcccagatgcctctttgcctttcttctggggcacggccctctgcaccccagggcagcctgtgtggtgtctgacgatttccacagcagccagagcagcttgtggcagccggggcctgctcccagcgaggggtctgctcccagcacggggcctgctcccagcgcggggtctgctcccagcacgtggtctgctcccagcacggggcctgctcccagcgcggggcctgctcctaacgcatccactacatctagtaatttactagttgaaattgttacatactagttacatcgtttacaaaatgatcatatttgaagaattagctttctgtggatttagtccacattgatgtgagcacctactgtacatgagatagcatgctaagtgctttttatttatttaggcaaaagataaaaagttactgctgctacaatctgtagtgttactggtggagctatgcaagctcgtggatttagggagtccagcctacgagaatggccgcctgtgacagaaagcaggggcgagcgtctgggaatagagctgtgctcatggcagaacaaagacgtgctgtgtttctggcctttgtgttctctccagtggtgaacaaacataggaagctttcatcttcagagtaaacagaaattccaaacccatttcacgcagctttttctagaaggcaatgtgtttaatccacttgttttccgagtctcttagtgtcatcacgacttcctcttatgtcggtgttaattactgtcacaggtatttgcgaaaactacaaggtctattcaggtcaagactagcttctctatttccacattttactttgtgtttccacaactgggctgttttagacctctgcagaggagaactgatttgaatcgggaaaagcaggaggtcccctcacggaggtggacaggacgcccactcctttcccaggctggcctccttgtctcatccctcaagggaagggccaggggcacggaccagcaggccagttgttcagtgttcaggaatctcaggagacattgttaaacattaaattacaaaaacaattaagttgtattaaaaagaaaagtctttaaaaatacctactcaaaacgtctttcttcctgattgtcttgctgagtgtttcgctgcagtctgtgcttccaaggatggcgtcatgtgtgtgcggcagaaaggcgaggttctggcaagagtgagtggctttaggtctgcacgctgtgttaggggagccaggggccagcgtggtggggttcccagagagctgcttctgaacttccagaagcttccagggagtccacgccacatgcacgagtgcgggacacatgctactcaggttccatccaagtctcaacctttgtttttacactaaagacatttttgttgttgtttttgagacagagtcttgctctgttgccaggctggagtgcagtggcacgatctcggctcattgcaacctacacttcccaggttcaagcaattctcctgcctcaacctcccaactagctgggattacaggcacgcaccaccatgcctggctagtttttgtatttttagtagagacagggtttcaccatgttggccaggctggtctcgaactcctgacctcaggtgatccacccacccctgcctcccaaagtgctgggattacaggcttgagccaccacacctggccactaaggacatttgaagtaagaagaatggatcagtaaacacttcacatttctttttttttcttttttttcttttttttttgagacagagtctctctctgtcgcccaggctggagtgcagtggcacaatctcggctcactgcaagctctgcctcctgggttcacgacattctcctgcctcagcctcccgagtagctgggactacaggcgcccgccaccatgcccggctaattttttgtatttttagtagagatggggtttcaccgtgttagccaggatggtctcgatctcctgacctcatgatccgcccatctcggcctcccaaagtgctgggattacaggcgtgagccaccgctcccagcctacatttcttaaatctatcttgctagctcctctcgcacttgaaatcaaatactccagcaactaacacttgtgaagcatttttcaattttcctgcacagttacattatctcagaacggttcattaccgtggggtgtgtgctcttcataaatgcaaactgatgcagaagcagccaccagccaaaaaatcggctttagaacgtacagttttgtagccttcattttttacgttacattttcagttaagatgtgaaaatcattgaaccaattcatttaataaaaagttgagtaacatttatattttgtcacttccgtgggtaaacataacaccaaatacttctcttgtaaaaacagcaacgtgtgcagggtatagaaattcatccattcccctgtcccctcttatccttggtgaggactcagaggtttgctgcagaaacattcgtgcctgcaagcaaaggaaaggattagagcaggaggcggctgggggagctctgggtaactctgggtggatgaggccacatcctgcagccctctggtgaggttcttcctgttgcgtgctggggtttaaacctggatctgtcttgctctgaagcagaggctctcacctgggagcagtcttgttccagccacccgcaacacacttggcagagtccggagacttctgaccgtcatgacggtgggggttgctcccaagaccctgctctgaagacttcctaacctgcgtgctctttcaacaatagcgcgtggacacatttttaacctgagcgatgtaacaaattcagccagctgtgacgatgacttttcagttttacattaacagttcattgaacttatacaccagtaaaacttctgtatcactgtgaagggctcagcaaatgtactttcatttattgatgcagaaattggagattggtactctttatcatctgcttactgtgtaaaggatgtttccaggatgatctagaaggttttcagtgcctgttttgtaaacttttaatttttttaatagaacaattttattttttcctattttgccaagaagacagaatgaagtcaattccgaaatggcaaattcttctgtttataaaatgttataaacattttatcaccagataatcacgttaatttttgtaaacgcccttgggtaggttattcgcacaagttatgcatttttcatgtgagttgcttttcacttaaaaagtgcatgcaacagaaagcaccaccttgtcgaatcgatgtgctgagctaattcctgtcatcattaactggacaggaaccgaaggaagccgtctggcaatatgccttagggtggcagatgcagcttggggcttaaaggaagagaaatagaaagatttgactctgttgaagagcagtgtgtcatccccgagccggattccatttaacatcttataaacaaaacgtgagtcttttcatttctcagtcttccgtgtaagcaatccagaaagtgggaataaaagtaatttctcttgtttttctctaattattcaaaattcatagtagtacagttgaggaaggggcacctcgctgtgagtttcatgcttcccttcgtccaggcgctgctgtgtcctgggtgctgtgtgtatagggcccccgccgagtccagtgtgggtggcagagacgcatccagaagcccccagtaagtttagcattacccatttgggtgaggactatggaagaagagttcctggtgatttcagtaaaaaagatgttttacatgccagatagaaacatgctcaaatgataacaacatgatttgggttgggttattaagttgtttttttaatgttctttttaaaaaagatttgatctcaatgtaaacaaacttgcctaatttttttcagctagttcacacagacattcaatatgcattcatcagctggccctgttccctcttcttgctcagaggctggaagaacttcccatgcaccaggtcatgtttgcgtaaatataattacactgtattatgtaaatatagttaccagcatagttgttaacagttctgccaataaatatttattgctttgatctgaatttgataatcaaactgagatttaaaacacagtggcccgggaagaatcaaaggaaattgtaacgacacattcctcattccttcagtccacaggactttttagatgttgttgggaggtggagtggggatgatgaccccttagccacagtttccctttctgtagtttcagttacttgagataaccgaggtatgaaaatattaacaggaaaattccagaaataaacaattcccaagttttaacttgtgcacccttctggggagcgtggtgaaacctggctccgcctgctccatcgctccagggactgaaccctcccttcgtccagcgtctccaggctgcggacgctccccaccccccttatggcctctcggttatcagatccgtggtccaggggtcgcagtgctcgtgttcaaggaaccctcatttgacttcatcatggccccaaagcacaagagcagtgaggcaggcaatgcgggtacacctaagagaagccagaaggtgctcctttaagtgaaaagtgaaagttctcgacttaataaggaaaaagaaaatggtacgctcagcaatctcaggagatgttgttatgttgccaagatctccagtcagatggaatcttctctctgtgaaactgggaacagcatattgttataattgttctattttattattagttattgttaatctcttactgtgcctaatttataaattaaactttatcaggggtgtgtgttcatagggaaaacattgtgtccataggattcggtactctattggtttcaggaatgccctggggtcttggaagcacccctgaggataaaggggacatcgtgcacataggtttgggtactatctcggattcaggagtcccctggggtcttagaagcacccctgaggataaaggggacatcgtgcacataggtttgggtactatctcggattcaggaatctcctggggtcttggaggtgcccctgaggataagggggttgctgcacccacaccattgcacaccttagtctgtcacttgtcagccggtgtggccccggctggaacactgtggctcattctagctgtgcttttagaaaattcttgagacacacctgttcggccaggttgcatagtgaacctgcagcaggggtggggcctccccagggacattttggccaagctggcatcagctgccccaggcttacaggctgagtgtcacactcacctcctccctactggagtcaactgcctagccctgtgggtgtttgagttcgtgacctcgatggaagatagaaagcagcaggaaagacagtccctgttatcaaggcattgtaacctaaggtcatggagactcgtgcttatgaggtatatgtgggttttaagtgtgtgggaaaccttcacagggcagctaactgcagacctcccaaacccctcctcctcctctgccccagctcagggtgggcttctgggccgggtcctgctggcctcctatcacagcgaggttggaatctgtactgtggagactgtggcatttctgcatcattcctgatgcccgatgctgagattaggaaatcggtctctgaggctgagaggcagtttctcagagtatgagctgggacctgaaaggccgctgttggaaagacagcagcagcctgcaggcctttgtgagaactgtctctatgggcccccgagactgctgtgcgcctgatgcaacaatcacttgttgacaggaggtgtcttcagtcccggccgtggttcggaggagaccacgataaactccttcaggatactgctccatcattttcctcacccgaagataagagccagctacagacgggtgtgttgggtgtgacgcaggctggaaatgtgcagaagtggttcatttttcttccccttaactcccatgtccctgtggtaaaattccattgctgtaaagtcatgagctcgaaacccagttatgctcagctaagttccacggaataatttcattcaagatcataaaacgtaaaacatcacaaacaaaaagtgtctctttacaaatgctcacggtatgacgggcagccctccaggagtggcgtggaggccggggcactcagtcacgtgtgtgccgggagcacaggccttcctcgccgtgcgcggctcctgagctctgagtgaggcagacggtggcagtgacccatccttttctggtaacttcttaggggcaaagaataaaaccattcttcagtttgccccattttatgcctttaatttcaaaaagcatttgacagacgcagaaaagcgcatccctgagcagccctgcgcggtggctgagtgcctgcgtccagggagttgagtataaagatcttcttccttcgtgataatttctatgcctgcatgtcttaccatgcctgattatagcaaatcccaggtacacgttataacaacagctattacgttgtaaaccgaaaacaaaattctaagcccccaaccaacggaatggacctgcatcttggccaaggggaccccaaggaaatgggaaaggcgagttcaggctctgatgggaagaggggctcggacaggcctcatcccaccctcctccctttggaccagcagtgacattaaaacagagacctgagactgacaaaacagactctctgtaccagtaagtttccaacctgactctagtgtaccctcacatgaccgatagcaggccctgagagaaattatcttacctcaaaatacatttcattgacatattttgaaatggcccctcacagctgtctcttgtgggggaaatttgcattctgtagagaatccacttccctttccagctcttttctggagggtctgaacccttttaggctctgctaagagacactcaccatctcttctctctgaagcctgctacctggaggcatcctctacatggaggaaccttggcttccacgacctccttatcttaacttcacgctgacttcaactcttcgtgccgagcttcactctttcaagcagtcgccagtcaggaaatctttgaatccacctgtgacctggaggctcccccaccccctgcttggagatgttgcaccttcccaggccaaaccaacgccaccttccatgtgttggtttatgtctttgcctgtcacttctgtctccctaaaatgtgtcaaatcaagctgtgccccaaccgccttgggcacacgttctcaggacctcctggggccatgtcacaggccatggttttaactttggcaaaataaacccctaaattgattgagagccatttcagatactttttgatataaacgtaagttgtggaaagagatgacatgttttgtttggagtgttaccaggagttgttaggatcttggaaagtcacagcttgcagtagccctgtttggccgtagcccccataaaagcaggagtatctgtgtggggtgatggaaccctgaccctaggcgtcctggcacggtggtgcctctgcattcacggtgacatcgctcctggacacttcgcctctgacacctgcggggccccggcctgttccttataggctcatgcttgagtgtttatcacgacttagcttccttgtgtctgtcacagacagtgcactgtagtggtttgtagaagttcctggtgcaggtagccctgttccttacgatttcatggaatggggacattaggaatatttgtttcctgatggaggggttcctgggtctgtcagggttagaagacctcctgatgatgagcagaacagggcagggagaactctgtctggaaggtccaggcctgggctgggcccccaccctgcctcccatccagacagagtcccaggtggggcctgtgggctgtgactgctgcagggatggcattaaaggagccgaagaggacctggaagcccaggaagctggtgacgtgccccctgcatcaggctgtgcattaagtcaccgcattcaaagggtttgtgtccccttgatgggctcgtctgcctggggctggggctgcagtgggctggaagtgcagagtcctgcgttcacactggatggctactgaggtgaatgggacccaggcacgttttcttatggaatgtccacagcctggttgtttatcccagaagatcagtaatagtgacaccctctgaccatgagccaacctctttccttagctcagggcgctaccagtctgggctggtagaagccccgacacttgcctcactcggatccctggaggaggattatatgggcactggggcaaggcagggacatcttggcagcctccccaccgcacgcttttcttgcaagtcctttgaacggcacctgctccttagctgctgcctggcaactttgagggtttcagtgagatggggtgagtgcttcccagccagcaaagtgcgttgacagtggctggcttgccccccctcccccccgccccggctctggaagcttctccccctgggtcttccagtctcatgtctggacacagacaggagaggtgaggaggagcagcaggggtggcccgggcagttcctgtgacctggaggcctggcaagttgttctgacggccaggcccatccttggggaggcctctgaggacgcctggaaccccaggcccgccctgccttgttttctggtcctggcctgggggggtcgtggtctcgctggtgcagcctcctccgggcaggccccgcctctgctcccttcccctcactccatctgattcggccccgtttccttgtccactccacgttcttctgagcgtgtctctgggacatggttaaggttaagaagcggcctctgaacgagggagaatgtactgaaattgcctaagtgaacttcaaacacaggaagaagcgctcagtcgatgttcatggtgagaacgagggttgatcttttgaatgagtcacgggtttgagagagacctaagaaccattcgatctgaaaactagattcactttgaacaaaatatctcaggtgctaaatactccagttagtgtggggaaatgtctctgagaacgaaagctctgactgaccggagcctgctacagtggatctgaaagatgctcacgaataattctcgctgcagagcttagtaaaccaacaatacaaacgattttctgtaacgacctcccgtaaagcagccactcccctcacagcgctgagcaggcgtaaccgccagggtcctcccccttctgaagccgcggcttccttgcaggccggtgtccggcgttgatcctttaactgaccatgggcagttttagttcacgagtgtggattcttgggatacggtcgggggcggatccccctgtcacgggttgtagaaattgacgcagcgttttccgatgtgcccacctgcttgaggaaggaatagtggtggagacggacttcttattcttcagatgtgcccacctgcttgaggaaggaacggtggtggagacggacttcttattcttccgacgaggcaatctctgcctctccatgcaaggtcgtccaacctgccttattttgttgtttttctgttttcttttgttttaggcttttagcagcctgaagccatggtttttcatttctgtctctagtaataagcagaagagggatgagtaaggggctttactggcccaaccagaaacaaaaagtaagaacccaaaactgtattctctcctttggacacctgtgctggggggagaagcccctcacccagaggctgtcacagggcattcctgggaccctctctttcccagactgtcctccctgcagagctgcgtccagaaggtgcgtcccggctgaatctatactgcagcctcaggtcagtgactggcccggcagtgtcttctggggtcagggtccttgcaggaccaccgtcacatgcttgcatccgtctccctgtaagggaaggggaagggggagggtttccctcattggcttctgcccaccccccaggatgggggcagaagcacctgagggagtctgcctcttccctccatattcactgtgctgaaagctgcagcaggtgcccagttctgcaggaaacaggctttgaacatggattcctgtgaggaggatgtgggggcgttgggggccactgtgggaaggtggggagatgtgggggtgttgggggcccctgtgggaaggtggggagggtgtgggagtgctgggagcccctgtggaaaggtggggagatgtgggggtgttgggggcccctgtgggaaggtggggagggtgtgggagtgctgggagcccccgtggaaaggtggggaggatgtaggggtgttgggggccactgtgggaaggtggggaggatgtgggggcgttgggggcccctgtgggaaggtggggagatgtgggggtgttgggggcccctgtgggaaggtggggagggtgtgggagtgctgggagcccccgtggaaaggtggggaggatgtaggggtatcgggggcccctgtaggaaggtagggaggatgtgggggtgttgggggcccctgtgggaaggtggggagatgtgggggtgttgggggcccctgtgggaaggtggggagatgtgggggtgttgggggcccctgtgggaaggtggggaggatgtgggggcgttgggggcccctgtgggaaggtggggaggatgtgggggcgttgggggcccctgtgggaaggtggggaggatgtgggggcgttgggggcccctgtgggaaggtggggagatgtgggggtgttgggggcccctgtgggaaggtggggagggtgtgggagtgctgggagcccccgtggaaaggtggggaggatgtaggggtatcgggggcccctgtgggaaggtagggaggatgtgggggtgctgttgggagcctggctatttgcctaaccacagaatatctgtgactgtctgatcatctgcacataattggcttttgaaaggggtgtgtgactcttttactctgaagagaggacattcttctgatacccagtctcacaataaaaagttgctacctttactttccccacttggccaatgatatcagtagccacactgcaaactctgaagtctctcagagctctagtctaggactccagagcgtgagtgcgtctgtggtggtgggcttgacctgaggctcatccttgtcacctgctcggtggcagtgcctgcgtgcagacccctcgcagcactcaggtgtggcccgtggacttgtggtttcgctgctggctggggaaccccctccggctcctcacttccccaccaagcgctggtcacagaaacgcccttctctggtcactgctctctggcctggcttggtggtggctttggtggcagccccgtcacccctgggatccgtgtcctcctgtttctttcgtttctcctgaaggttttccaagtgcctgtttgcttctgggaatttcctctctgccttcctccgacttcctcatagccgttcttttattccggcctcccaagattgcgtggagcccggccactgccagggcggccctgtgatgagctacatgggacacaagaggcagccccaggcgcccgcctccacctctaccagcagcgtcttcgctttcacttctgccttctgcggcgtcttcctctgtggagttggcgtcggccactggctgtggggcaacctcagcctctccagcggacgctgcaccatccctatggtggagtctcagctttggggatccagggtgcctgccggatttcagacagcgcattcacagactgtcgccagctgagccgccctggtgtctggagttgttctgtgtatgctgttatccagttactgactcgcagtcctgcagttgtcttcattagatatatattcaatattttggaaatatgcctacaatgcattcgttgtctcggccagtggctcgtgaccctctgcacttggaaggtatataatttccgttgcttaaaaggcgacacgtatactaacatgtttgtttgtgaattgggatatgcttgcttagttttctggctaattcatctttagaaggagggactcagtcgtggggaataaacgcagcgacccctcggtgttcccgctgggctcgtgggtgacgcagtgttttccggtggcttgggaagaatctggaggtcgggtgctgaggcttgagcgtctctcctgtaggttggtttcgcccggtcctcagggcggagttgctgctcattctcatgctgggcctgttttccgattcctggtgctctcttgtcttcacctgcagttcacttgcgggcagtggaggctgcactgtgacgttagtaactgtgaaggtgtgacccatggtggaaagttggttatgtctgtgattgatggggaggtgtttgtggtcgggggtggaactgctatggggggaaggtttgcaagtcgggagacgggagcaatgacagggccccatgggctgccccccggctcctccttccaggctcctacccttccccatgcccggcctcccccacttgcctttctcttcttgagtcagcaccactactcacacccctgagcgtgtgccagggctgagctccaaaccgggcacaggacctcccggccccacggcgtgcctgcagccccgccctcctctctgaggctcagaggcacagcaggtgcagcacagccttggccctgaggctcccagcatggttgtcccggccagtggcttgtgactctctgcccgctgcgtttgggggtgaactgaaggagcccgtgacccgggtccctggcagctgtggcctctttgctgcgcttcctctttggccagagccaaaaccaggttctcttctgcacactggagcagggaccttggcctcaaattctaatgcctgagtttatagttctcccaacttccccagagccggcccatagctcagtcatgtgaacctcgacaccaccctggttttccaggtgagatgagcctcagtgacaggcagaaacacgtggccatgaggaatgcaccagcctgagtctaagggaaagctgccgatttctagcactgatttgcagaggggtgggcgagcctgcccagtgccctgtggtgaagaggagtctctgtcctgagagaggcaccgtgaaggcaccgtgctgaggccagcctcagagccgcggggaagccaggtctgtctgatcgcttcccagcacttcccgtgccatcccacgcggctgtaaatggacacacgttagccacagctgctgcttcacaggcagcctggtcagaaacgtactcctgtcgaaaatggagggtgaatcgcatgaaatcagcgttacgtttgctcctgctgcatttcatgagtccagcggagtctgttccaactgcaccccccaatcctggacgtgctgtgggctccaagcgatgctttggtcaccggctcttttcctctgtgtctcgactcttaggaagctctgtgtttcttcccactgttgtgaactatcagaattaggcattccagagtaggccaagaatgatttggggtgagaatttatatttttatttcagttctggacccagtaaactatggtctaggtccgctggcaccccacatttcccaggtcgactgtgtttccagatcaaagggatgtccctgtgcttttgtggatcattgtgacccaagtgattttgtgcaaaaaatatcttcatggcaggagaatgccactgagagccttgaaaatacctgagatttgtttgaggaagaaaagaaaaaaggaaggagagaaatccagtcgttaccatgagtgtgacgagagtggggagaaccagtggagcttctgatcctgtcccagcagatgccagtggctcggaccaaggaggacagagggatgggcgtgcccacgtgaagcctcaccccagaccccagaccctgcttacatgccgggacgaaggtgggagagaaccgtgcatctcagcacggcggtggaaacgtggtccacctgcggagggcctgtttgcgtttattacacccgagcaaggcccgcacgcccaccagaggggccagggtgcccctgggagccactgagagacgggggaggcacaggctccacgcgccgcttccctggactgctaggaggcggcgatggcgagtcaggaggaagcctatttttagaaacgcttaagtgcccacgatcttctgaccatcaaacaagaaacgttgctgtttgaagctatacacggacggcagaacaagaagtggctgtgtcactggatacctgtacatttgaataccggccattagggagaatcgccctgtaaacattgatccagtgattgaggccggtcggcttgcttctgttctgccccgcggtgtaattcagctaataggttttgtttgtctcagctgaaatgtgaaacttccattaggtgtctaaccctggctaaaagtggttttcagcctatttttaaaaaatctcctttgtccctgcatgcattctaaccccattctaacctgatgcgggcagccacaacccaggccctaacagagttcatggtaaggatggtgaaggcgtgacccacggtggaaagttggttattttgggtaatccagcgattttctgattgaacttcgaatgcggaaacatcttgcccttactggggcaacgaggggaggcaaggcgtgcgccaggcagagacaccttggaatcccacccagcccagatgtgtctcctgggttctgggacgggcgcaggtgactgtatttgcgctggtgggaggagttgcccccttggttaaatccggaggacacagctgcatggtgcttgccctcagccgtttctctcttcttactttgagaataatctcttttttttctagtttctcttttcttaggcatactcctttggaaacttactgggctcacttttacccactatgagaccctatctgtcatgagtagtgcaaggttagagataaccaggtccacatgcacttgtgtctttctgtagtgtgaggcctttgttgacgttatttcagtcacaaaagccgggaactgctggtgcttcccgtcactcgggtagtcccagccgcgggcacacaggctcaagccactcctcacatcagtcaatgttgtaaaccatagtaatagtatacctaatcaatacataaatgttataaacactccacaacaaacaaagtaacatttaatatcaagagaaaaagggagataggaggaaacgttaatgaaccagtccggtggggagtgaagcagacaccgggagccctgggctgggcggggtggtccgtggtcttacgaggaggactcaggtggcagagcctgcggggcagatgccaagttcttatcacaagtgactgcgaggcggcagcggctgaggcagagtcctcccatgagaactgagtgctttttgtgtccttacctggttggatactgtcctattttttttaatttgtttattaagcaaatcaccttatctttgttggcaaagtgccctatgaaatgtaaaacaaagtctttttctaagacggagtttattatgtcaacagtgctctatatactatatataaaaactaaactttaaaaatgttgctgacacgaaaattgagagaagcctacgtttgtgcagaagatgggcaggtagaaggttccagcggtgaggggtgctgacctggagcggctgcggtggggccatgtggctggaagcagggcagtgagcagtgctcagcctgtcgcgagtgtgtaggaagagagctttgttgaaatataacttacatatcataaaatcacccacttaaacaatttgatgagttttattatatttaccaagctacacaacatcaccacaatctaattttaaaacattttcatcaccctcaaatgaaaccccatgcccagtaccaggccctcccaagtgcttgtcatcaccctcaaatgaaaccccgtgcccagtaccaggtgctcccaagccctgtccccagctcccctcccgtcatgccccagcccagccctgggcagctgctaatgcaccttctgttgcccgcagatttgcccgtgtggacgcttctcgtggatggagtcaagcagcctggggctttgtgactggctctgccacttggcggggtcaccccgcatttccctggtgactaagggtgctctgcgtcctctcctgggcttgttggccatttgcaggtctctagagaaattccgccttgtcttttctatttttgagtttgaatcattctgtatatattccaggtacaatctctaattgtttatgattggcatctgatcacggatgctccatgtagggaatggctctgccatgaaagcccaagaaccctgagtgtgtccacgtgggccatacagggaaggcctggtccatggtgatctctgtctgggagggactcaggagcctcccagagccccgagggctgtggcctgtgaggtgctcccttgtgccatggcccatccatctctctccccagagggtgccatgaggctgtttctcatcgcctctgggttctgatgagctgtggcgcctcctgccctgccctgccctgccctgccccaccatcgccaccctcagaacagaatgcaggctgtaaaccgcttagtggtggcctggattggcctgcagcagtttgcgtggtgtcaccctgcccttctgttttcatgtattttaatttatttgctgcttaatctgagcaaaggaaatgccgcctctctctgtatcgaccaaacccaccatggctttctcttcccacgggtgagtcttgctttcccgagctgtacgggtcccaagccgatgccaggcattcagccagtggccaggagtccttccccactctccctgccctctgaaagagcaaatgaagggaatccttgaacctctgggaagctgtagcccttttgtaaatgtgcagccctgtggcggatgggggtcccaggaaaggcccagggctttgtctgcagaaacagctttttcctgtgctcttttgggtaactggtccttcctcaacactgttgatagcagctgtggcgctgggctccatgcagcctgcagcagaacagggtgtttttagtcgtggtgccctctgtgtggcacctgccaacgccccgcgtgtgtgagtggcgatctgcgtctgtgggtgacgcgcatcacggggtgtggagaggtgcacctgtgcgggatttccacgccacctccaccctccaccctccaccctccaccccacctcgtgccttcccagggaagtcctgcctgtgcctctgctgccttgggaagagaaggggtcccggaggaactcacagagcggtggaaggcatcaaagaacctcagctcctcaaacacagtgcccgctgcctccctgcttcccgtccacctcacggggaactaggaattccctcctgtgtctggcggagagagaacctggctaagcattgcggccgaaggttgcagcctcctaggaaatgtccaatacaaaggatagactgcaggctattttgattttactcattttttaacagaacttttatgaaagcagattttacttgggtctggtgccaggatttgtctttacttgtcacatcagctgatgcctcccaggtttcgtaagtcatctgttctaaactggaagccaggtgtcttacatcaaagcttccggtatctccagttgcagaaattagaagagggtggttgaggaccatgtcttcctgggtgacgcccttgagaagatgtcacacctgggccctgtttattatatttggagaaatgggagacgatgatactttagaggaacacagatcccattccagcaactattttaatcagggactctcaggggagggtgagattccaacttacaaattgcaaatgtgcgatgtgctgcacccactcacaaaagacgtgtaccagatcacagttgcggctcatttcaaggtaaagcagccctgaaagacatgcagaaccagagcggttgcaagacccagactgagcagacaggggaggcttcgccttcctgtgtttgcatgcacagcccggactgcatggtgacttacagtgtatttctcatcccaggtcacagtctcagagtgtgagagccctgggtctctgggtcaggtctgaatgaacgctctttcctatgggccttttcctgtcactgccctgtgtatgtcagactggctaagcaacacacatgtctaccggcatcggtgaagagcgtcgttggcgtgcgaggctgtgtgtctgagcagctcctcccaccttcccccgtcacgggagccgcagagttgcaagaccctggggaatggaggctttgttgttcggtgggtcccacttcatcggggtaggcggcaaggccagcgggctgcagcgtgtgcctcggatgtggcgtctgagggacagcgagtgggttgcccgcaggggccttgcttgcactggcttagagagctaacagcgtttggtgggactcagtttatcgttctttccctgctttgaggcaggcccttgatgtgcaggtgaagtgcccgtgggctggccgcgtagcttccaggtgtttcttcttccagtggggttggcagaacacggcgtgaagctctgctgtgaagatgccgaaaacagcgcccctctctgctgaagggctcgttatccgactctgccttagccccgtcctcttccttcctaccacacagcgggaggcatgggatgcacacaggcgggcttccacagtcggggggccgctgacaggaggaacccctcccagcagcttcagggtgcttttggcccagcagcctggggcctccaggacatgcctcctctaaaggggtgttaggtaactgcagttttctcctctcctacttaccgttgccagagtttttaaaaagaaggaggcgaatactttcaaatgacttatataaaaatctatattttaaatttatttctgtaagaaaaaaattggttggtacaaatatagcaaaaatgttaacatttgtgagatctgggtgatttatttccttactccagttttctgcacgtttgaattatttcataatgccccccccgcctgtaagtgggtgtatctggagaggtgtcatccttcctgaagagggacagtggctgagccacttgtgaccagggaagcccagcccacacctccacggccctggcgcagggcgggcgcgacttagttcacgacaacctagtttctgcccccagttccaacttggggtcagccagagaacagcaagtacgcccccgtccccttctccccttgccagccccacaggctgctgcgcctcccgggcgtgagcccacgccgtcaggcccacagctgccctcccagccctcttccccggaccccttcccgcctccctggcccggctggagtccctgggagcccgtggaggcggctgacctgcaggctcggagtccgtggctgctgctgcttgttccagtggctgtcgtttgtttccacggggattcatgttgacatctgttactcgtcctcaagtgagcccgtctgcatgaaggcacaccttggggctgctgagtcagccacatccttgacagttccccacagcccctgtagtgtgtcctgtgtgtgagcaaaagcgcaggccagatcccagaccctccttccatccccggactgggcgcattggagcaaattcctccatgctgcctgctccgtcctctcccttgccctgttcctttccatgctttattaacggggaaatgtggggagggtcagagggccagtgaggccagtgctgcccctcaaaaggcaggtgtctatgctgcgtgacactgaacgctgcctaaaccatctggataattgatcgggtgtgagtttgcacgctgtgctccggcctgcctggcgatggttctgggtttggtgttgcgctctgtcaagtaggaagtgatagtaaattctattttatttatttatttttttgagacagagtctcaatctgtcgtccaggctgaaatgcagtggcactgtcctggctcactgcaacctccacctcccaggttcaagccatcctccttgcctcagccccccaagtagctgggactacaggcatgtgccaccactcctgcctaatttttgtatttttagtagagacgaggtttcgccatattggccaggctggtttcaaactcctgacctcaggtgatccacccaccttggcctcccagagtgctgggattacaggcttgagcccccgcgaccagccgagatgacctgtcgggtgagaggcttcagctcctggcctgagattaatatctgaccaaatgctgtggtgcacactgagagtgtcgcatcgtagatcttctgaaacgcagcgtcttgccccttgagcctctctgcaccgcgggtttggagttcatgctcctgtggcagtggcctcaggggtgtttgctccttagggaaattttcctcgaccactgaacacaggtcctgggcacctgtcagaaagccacactgccaggcaccaccaagctcaggcgctggcacctgtcagaaagccacactgccaggcatgtgcacaaagactgtgtgttttcaggcagcagtggatcaatcccaaatgtcaaaactatctttaaaaaaataactaaggctgggcatggtggctcacgcccgtaatcccagcactttggaatgctgaggcgggcaaatcacctgaggtcaggagtttgagaccagcctggccaacacggtgaaacccagtctctactaaaaatacaaaaattagccaagtgtggtggcatacacctgtaatcccagctacttgggaggctgaggcaggagaatggcttgaacccgggaggcgaaggttgcagtgtgccgagatcacgccattgcactccagcctgggggacaagagcaagacttcgtctcaaaaaatatatataataacataataattaagggaaggagccacagaggctgcccaggtagctgcattgatgcaatttgtggtgacattttctctgaggctgctgtgctgtgcggttacagctgcccctctgcgaagccccctcccgctggaaggtgggtgggaaggctgccggaaggctgccaggatgctgtgcggtgccaggtcctgagcacacatatcaggagaagggatgtgagacttcctcccccgtgggctccatgcagccaggaagccctgccgctccctccccatgcgctccccacacgccgctcaccgtgcctttctcccccaacgccagatgtggaattcctctcggaggtgctcttatggcaccctgcacggagaggcctgggcctggccccgaagaaggcacagcccatgtgcaggcgcctctgtctggaaggcatgctgcgtccattttactgtttccccaaccctgtggcactccttcctgttccttcttctacagtcttccgtgtgaatcgtggaaatgagtcagatgggcatgtttaacatcataccacacataccttttgcaaaaatgtattttttagcggccaggtgagcagctgatgtggtggacagaaagctcaccggaggccccaaggccttgcagcctccacgtgcctctcatcagtgtgtgaggtgcagtaggcggaggtttgctgagcttagcggctctgtgagaggaggtcgtccaggtcagcggctttgaaagccccggcacactccagctcccatgcagttatgctgtgtaagaaatggcaacagggccaaaaccttgtaactctcttcagagttggacgtaaaacactgaggtagctagaaatacattctaagttgaggtaatttggggcatggtggcatgcctgcaatctcagtgctttgggaggctgcacagggagcattgcttgagcccaggagttcaaggctacggtgcactgtaactgtccctgtgaacagccgctggagtgagtagccactggaatgagtagccgctggtttgaggagtagccactggagtgagtagccgctggagtgaggagtagccgctggagtgaggagtagccactggagtgagtagccgctggagtgaggagtagccgctggagtgagtagccgctggagtgaggagtagccactggagtgaggagtagccgctggagtgagtagccgctggagtgaggagtagccgctggagtgagtagccgctggagtgaggagtagccgctggagtgagtagccgctggagtgaggagtagccactggagtgagtagccgctggagtgaggagtagccactggagtgagtagccgctggagtgagtagccgctggagtgaggagtagccgctggagtgagtagccgctggagtgaggagtagccgctggagtgaagagtagccactggagtgagtagccgctggagtgaggagtagccgctggagtgagtagccgctggagtgaggagtagcccctggagtgaggagtagccactggagtgagtagccactggagtgagtagccgctggagtgagtagccgctggagtgaggagtagccactggagtacgagtagccgctggagtgaggagtagccactggagtgagtagccgctggagtgaggagtagccactggagtagccgctggagtgaggagtagccgctggagtgaggagtagccactggggtgagtagccgctggagtgaggagtagccgctggagtgaggagtagccgctggagtgagtagccgctggagtgaggagtagccgctggagtgagtagccgctggagtgaggagtagccactggagtgtgtagccgctggagtgaggagtagccgctgtgcttcagctgggacagggcagcaataccccatctttaaaaaaagtaattaattattgtttaaaagtaaatagttttcacttcctcggagattttcaggaagagctttatatctaagtttctagaatttacacagaagactgaaacagagaagcacttctgacatctaggaatgacttttcctgccaggcgcagtggctcacgcctgtcatcccagcactttgggaggctgaggcgggcggatcacctgaggtcaggagttcgaggctagcctggccaacacaccatttctactaaaaatacaaaattagctggacgtggtggcgcttgcctgtaatcccacctactagggaggctgaggcgggagaattgcttaaacctggaagcggtggttgcagtgagccgagattttgccattgcactccagcctgggtgatgagagcaaaactctgtctcattaaaaagaaaaaaaaaaaagaatgacattttcctctaaggtagtaaagaaaatcacttgagtcattaaagcattaaaccaaaggcaagctgaaaatcagagcaagtttgatggtggtagttgtacagatgagtgatatctcttgatgccaaggtgactgttaggtttctagaatgagaaagtgtggaaataatgatctcgtgtgcaaaccatgcatgcctttcatttggcaaaaatacttacaacatttttactgaggtataattcacatactgtaaaatcctcccttttaaagcatgcaatccgttggttccaactggaaaatattcaaagtcgtgcacccaccaccaccctccaacccagaaggttttcatcccccagtcagaggcggtcggcagccaccaccgccctccaacccagaaggttttcacccccgggcaggggccatcagcagccatttgcccagcccccggcagcccccgtctctgcgttcgccttttctgggcatttcctcagaatggactcacaacatggtgttgcttcacacatgggatgctttctgtccccacgcgtgttgctgtgggtgtcggcgcttccttcctttccgtgtatcccttcatcagtggacgcgcgtttggaggctgccacctttgtcttccatgaacagcgcagccgtgaaccttctcgccgaattttttgtgcccctccaggagtcgctcgagatgtttcctttggtcggtttgtgtcctatggtcagtcacatcagcacagggtagatttttacttcagctggaacttgatgccagccctccaggggacttgccacgtggctttctcgatgcagtttggacaatgggttgttaatgagtcattaggaaacctgttacttgacatagacagtttggtgcctggtttcagctttgctttgctgatggaagcctctggccgtgggtgggttctgctgcgaggagttgcacagggctggctgagctgtgtggctgatcctgtctgggaacgcggagagagagaggctggggtctccatcctcctgccctggagagcttcccgactacccgtgtctttgctctgaatcctgaaaacagccccgtgtgatgtgaccccgtcttttgtttgtttgtttgttcgtttgtttgagacggagcctcggtctgtcatccaggctggagagcagaggcgccatcttgtcactgcaacctccacctccgggttcaagcgattctcctgcctcagcctcccaagtaggtaggactacaggcgcccacatgcccggctaatttttgtattttttttttcagtagagatggagtttcaccttgttagccaggctggtcttgaactcctggcctcaagcgctccgcctgccttcgcctcccaaagtgctgggattacagacatgagccaccatgcccggcagggaccccgttttgtctatgtccccgtttatgcacagtatgtctggccctggattcaagaccggtgaggttcagaagttacacgattgaggctcctgagtttgttttcgttgctaactgtacagagaaccagaatcctagggctgggaggaccacgaaggttgggcctcctaatcccttcatgtcgctgctgacaacatttgacggacgcgtggtgtgaggcagccgcagccacagagccagtgagcagcagggaccgggcgccctgtccccaggctgctgttagtgacggtgtctgcatcctctgggggtccagcgtgttttcggctctgttccttttgggcagtttagtcttcctagaatttgaccatgtgtgggctgctctgtctatggagtagctgttcttttattcatttgctttcttaataaacttgctttcactttgcaaaaaaaaaaaaaaaaaaagaatttgaacatttgtggagaatacaacacaaagagctccctttggtttgaagtgtgaacctgaagagacatgtatgtttccgaccttcctgatgccctgggtgaggccgtctaagtgacctcatggcttcaggtcctttcctgttccaatctggtgtctgttatgctgacgaggccatcaggcaaggccgcgcacttgccaggcaaggcccactgcatgttggcaggcagcctgttttctgaagccatggcacagacaagaatactcattcctacttgtgtcgggttaaacgccgctacactgttgggctgtatctgagttgtttttgatgtaattatttaatgataaacgtctgctcgccggtgttgagactttggagtgggcttcatccattcatcctgatcgttcctccatgagacagggtccctttgttgctggctggaagcggccgggaagcgtgggctcgctgtggcatgggcaatgccacacggctccagggaagcgttcagctttccaaaccagtgtctgggctcgtggccactcctgaaattcagttgccgtctttgaagcttcgaagaaagtttctaggattttcacttttgtattaaaagatatctgtatgcttttctctctttttctggttcacttatattcttattcagtgcaatttcctgatttcacgagaatgagaagcatctatttggctatgttctgtgaaaacaaaggagccagggactttgcttagcctttataggcagcagtttatttatgaagctcttaggatgcttttaaagtccacatccctgtggtttgttggcttcaccacaaaatagagacagcagggaaggcccccgtcaggcagggagacccagtcccggaggaggagggcccgtcctcgtggggaggggcagccaggctgtggcatggtcagggcagtggggctgtgctgcccacctggctttgagtccaggatgacggttactgcatggccagcaggctcgcggggaggccacgacccaaggtcgcgctgaggaaaactgcgtctggctcatttgagggtggagtgttcctccctggcctggtggctgccttgtacgtctgtccccaggagcatggaagcctcggctccccgtggaaacactggttgatagtctcagccaaacatctctgaaaacacagttggggcacatggagactgctgtggtctctttccgttattttacttagacttttctgcaaagctgagtcctaataaaagaaattgcaggtgaattaccgatggaatttattaaagcaaatgtgcagacattcacacagctcctgtccgggacgttctgggtgggacagtgtggaaagacttcctctgagaggttggtaggggagcagaggagctgatgacatcaagtccaaaaacagccccatgaggtttataaacaagagcaccacgcagacagggactccagactgttcagaccctgcctgccttttttggctttaaaaaacgagagttccctgaagcaccgaggggcagcccacacagagaggacttggccctgagcatttacaagtgtctgtgctgggccgggcccctggccttgttctgttcccgttgcctcatttcatgctccaggaccctgagaaagtgctggtgtccccctcatgggtgagaagctcagcgggaaactgtccccgtgcctgcggcgaggagtggcccagcagccaagggtcagcccttcgacggcagtgcccgctcgtccttcccgtcccactgcaccagcattcccctcatggaggaggcttccgtctcctcttcagctgtgtttctcatgccccagaaaggctgatgtcttgcagttcctacagagaactggggcgtgggacgagagccacacgctaaggccccgtattccgaggtgggctcagggccatggccagggctgcgtattcagatgtggcgtttggatttcccgttacgagctaaagtatttttgtggttttagtgctgacatcaaatggcccgcctgagtgttgttgaaatatttcttgtcagagctgtttccttaactcctccaaatacagtgttccgagtaatacagagatggtcaggcccaagtcagctttgcaggagagccttcctgttcctgagcagacacctagcagggttgagcgactcttacccatctgcagatgcagggccggtgaccccacagtggggcaagagcctggagagctcttggctttgcccaggaaggaattcaagggcaagcaggaggcggaagaaacagcttcattgaagaggctacagctccctgactgcccctgcagagcggggctgccctgttaggcggagaggagtagctcagggcagatttaattgcatgcagattaaggggtggtttatgcagaaatttctaggagaaggatgtaacttgtaggcgatcgggtcattgccatggaaaggggccgcagctcctggctgttgccatggcaatggtaaactgatattcacaccgcgggcatgtcttatggaaagctgcctctgccccagccctgttttcaccagtcctcaatctggtccggtgtccaagccccacctctggagtcaagtcccgccttctaccccagtatcatagtttttctttcctcttccattaaagacctttcccaacatcactgtctcttctgttttggaagccttacgatttggccacacgttctgttctttttttttttttttgagacagagtctcgctctgtcccccaggctggagtgcagtggtgctatctcggtcactgcaagctccacctcccgggttcacgccattctcctgcctcagcctcctgagtagctgggactacaggcgcccaccaccacacccggctaattttttgtattttttagtagagacggggtttcaccgtgttagccaggatggtctccatctcctgacctcgtgatccgcccatctcggcctcccaaagtgctgggattacaggcgtgagccgccgcgcccggccgcgttctgttcttatgtacacgccctgagctgtttccactggcagtcagctttgaagttcactgtgtggctctcacaggagcgcagaccctcctggtgctcaccagaagaccttggcccatgagggctgcgtaagacagggtggctcgggcctggggtgctgggccccaggtctccctgcagccctgaacgatgctctcagcagcaggtacaggtctccgttccgacgaacgtgcctcaaggcaacactctgggcaagagcttttgatgcaggttctgaggcagctgcctaacaccgctctcctttccgcagtgtgcaggagaagagaattgggtggacagcaggaccatctacgtgggacacagggagccacctccgggcgcagaggcctacatcccacagagatacccagacaacaggatcgtctcgtccaaggtaacttggcttgggtctgagtgtccataatgtgtctaaaaagcagctgccggggggtgttagtgcttctcggtttcaaagagcggctctgctcctggccctgctgtcacagccaccagccacccccagcaagggcttcggatcaggacctcaccgagggcgctactctctccctctcggtgactgcccacaggaggctttccacctgcccagggctcacagcgcagtgtctccattctcgggtgaccgtgccacagaggcagtgcaggtctgaagtccaggatccaaaccctacccaggtcccacttctgaggcgcctggccacgtgcttgtcgtgggccaccctggccagagtctcagtgccagtaaggtagaaacgataccagccaccccggagaaagagccaacaaacgcaggctggacagcaaaacctggggggaaatctttgagcttgttcacgaggtgcagcccaggtaaagcgtaggaagcacaagcagagtgccgcggtctaaacgaagcgtgtttctctccatggactagagcgtggaagtgcacacacatttcccacgttcagagagtgacctggaaacaggtcttaagaacaaggtggaaatttagctgctgccattaaacatggggtaaactgtgctttccaggtaatgcggaacgcacgtgcctgcgttcagactccatttatcttcaccgtccttcaaaatggatgagctaaacccacgcacacgcgtggacgggctgcacatggggtaaactgtgctttccaggtaatgcggaacgcacgtgcctgcgttcagactccatttatcctcaccgtccttcaaaatggatgagctaaacccacgcacacgcgtggacgggctgcacatggggtaaactgtgctttccaggtaatgcggaacacacgtgcctgcattcatactccatttatcttcaccgtccttcaaaatggatgagctaaacccacgcacacgcgtggacgggctgcacatggggtaaactgtgctttccaggtaatgcggaacgcacgtgcctgcgttcagactccgtttatcttcaccgtccttcaaaatggatgagctaaacccacgcacacgcgtggacgggctgcacatggggtaaactgtgctttccaggtaatgcggaacgcacgtgcctgcgttcagactccgtttatcttcaccgtccttcaaaatggatgagctaaacccaggcacacgcgtggacgggctgcacatggggtaaactgtgctttccaggtaatgcggaacgcacgtgcctgcattcagactccgtttatcttcaccgtccttcaaaatggatgagctaaacccaggcacacgcgtggacgggctgcacatggggtaaactgtgctttccaggtaatgcggaacgcacgtgcctgcattcagactccatttatcttcaccgtccttcaaaatggatgagctaaacccacgcacacgcgtggacgggctgcacatggggatgcctgtggcggcccaccattcacacgtgtgccctcacctgtagacgcatttaatttacattgggtgtcctgccgtgtaaacttctgtggagacctacttaattcacaccaagtgtcctgatgtgtagacccctgcgatagacctacttaattcacaccggtgtcctgacgtgtagacccctgtggagacctacttaattcacaccgggtgtcctgatgcgtagacccctgtggagacctacttaatccacaccgggtgtcctgatgcgtagacccctgtggatacctacttaattcacaccgggtgtcctgatgcgtagacccctgtggagacctacttaattcacaccggtgtcctgacgtgtagacccctgtggagacctacttaattcacaccgggtgtcctgatgcgtagacccctgtggagacctacttaattcacaccaagtgtcctgatgtgtagacccctgtggatacctacttaattcacaccgggtgtcctgatgcgtagactcctgtggatacctacttaattcacaccgggtgtcctgatgtgtagacccctgtggagacctacttaattgacaccgggtgtcctgatgcgtagactcctgtggagacctacttaatccacaccagtgtcctaatgtgtagacccctgtggagacctacttaattcacaccgggtgtcctgatgtgtagacccctgtggatacctacttaattcacaccgggtgtcctgatgcgtagactcctgtggatacctacttaattcacaccgggtgtcctgatgtgtagacccctgtggagacctacttaattgacaccgggtgtcctgatgcgtagacccctgtggagacctacttaattcacaccaagtgtcctgatgtgtagacccctgtggatacctacttaattcacaccgggtgtcctgatgcgtagactcctgtggagacctacttaatccacaccgggtgtcctgatgtgtagacccctgtggagacctacttaattcacaccggtgtcctgacgtgtaaacccctgtggagacctacttaattcacaccggtgtcctaattcacaccggtgtcctgatgtatagacccttgtggagacctacttaattcacaccagtgtcctcatgtgtagacccttgcggagacctacttaattcacactgggtgtcctgatgcgtagactcctgtggagacctacttaattcacaccggatgtcctgatgtgtagacccctgtggagacctacttaattcacaccaagtgtcctgatgtgtagacccctgtggatacctacttaattcacaccgggtgtcctgatgtgtagacccctgtgtagacctacttaatccacaccgggtgtcctgatgtgtagacccctgtggagacctacttaattcacaccaagtgtcctgatgtgtagactcctgtggagacctacttaattcacactgggtgtcctgacgtgtagactcctgtggagacctacttaattcacaccgggtattctgacatgtagacccctgtggagacctacttaattcacactggtgtcctgacgtgtagacccctgtggagacctacttaattcacaccggtgtcctaattcacaccggtgtcctgatgtatagacccttgcggagacctacttaattcacaccggtgtcctcatgtgtagacccttgcggagacctacttaattcacaccgggtgtcctgatgcgtagactcctgtggatacctacttaattcacaccggtgtcctgatgcgtagactcctgtggagacctacttaattcacacctgtgtcctgatgtgtagacccctgcggagacctacttaattcacaccgggtattctgacatgtagactcctgtggagacctatttaattcacaccgggtgtcctgatgtgtagacccctgtggagacctacttaattcgcacctggcatcctgacgtgtagactcctatgtagacctatttaattcacaccgggtgtcctggcgtgtaaacccctgtgtagatctacttaattcacacccagcatcctgacctgtagacccctgtggcgacctacttaattcacacccggcatcctgacgtgtagactcctatgtagacctatttaattcacaccaggagtcctgatatgtagatccctgtggagacctacttaattcacacctggcatcttgacgtgtagactcctatgtagacatacttaattcacattgagcatcctgacatgtagacccctgtgtagacctacttcatttacaccaggtgtcctgatgtgtagacccctgtgtagacctacttaattcacaccgggtgtcctgatgtatagacccttgtggtagacctacttaattcacaccgagtgtcctgatgtgtagactcctgtggagacctacttaattcacaccaggtgtcctgatgtgtagacccctgtggatacctacttaatccacaccgggtgtcctgatgcgtagactcctgtggagacctccttaatccacaccaggtgtcctgatgtgtagacctctgtggagacctacttaattcacaccgagtgtcctgacgtgtagacccctgtggagacctacttaattcacaccggtgttctgacatgtagacccctgtggagacctacttaattcacaccggtatcctgacatatagacccttgcggagacctacttaattcacaccagtgtcctgatgtgtagacccttgcggagacctacttaattcacaccgggtgtcctgatgcgtagactcctgtggatacctacttaattcacaccggtgtcctgacgcgtagacccctgtggagacctacttaattcacaccgggtattctgacatgtagacccctgtggagacctacttaattcacaccgggtattctgacgtgtagacccctgtggagacctacttaattcacaccgggtgtcctgatgtgtagacccctgtggagacctacttaattcacaccgggtgtcctgatgtgtagactcctgtggagacctacttaattcacaccgagtgtcctgacgtgtagtagacccctgtggagacctacttaattcacaccggtgtcctgatgtgtagacccctgtggagacctacttaattcacacctggcatcctgacgtgtggactcctatgtatacctatttaattcacaccgggtgtcctggcgtgtaaacccctgtgtagatctacttaattcacacccagcatcctgacctgtagacccctgtggcgacctacttaattcacacccggcatcctgacgtgtagactcctatgtagacctatttaattcacaccaggagtcctgatatgtagatccctgtggagacctacttaattcacacccggcatcctgatgtgtagactcctatgtagacctatttaattcacaccaggagtcctgatatgtagatccctgtggagacctacttaattcacacccggcatcttgacatgtagactcctatgtagacatacttaattcacattgagcatcctgacgtgtagacccctgtgtagacctacttaattcacaccgggtgtcctgccatgtagacttctgtgtagacctacttaattcacaccgggtgtcctgatgtgtagacccctgtggagacctgcttaattcacaccgggtattctgacatgtagactcctgtggagacctacttaattcacaccgggtgtcctgatgtgtagacccctgtggagacctgcttaattcacaccgggtattctgacatgtagactcctgtggagacctacttaattcacaccgggtgtcctgatgtgtagacccctgcgatagacctccttaatccacaccgggtgtcctgatgtgtagacccctgcgatagacctccttaatccacaccgggtgtcctgatgtgtagactcctgtggagacttacttaattcacactcaagcatcctggcatgtagacccctgtggttcttaattatttatgtgctcttgaagagttgcacatttttaaagaatattttacaacagaaaaggtcaccttttcaaagccttttttatgggattaatttgtaactacaggattgcaaaaaattttaatagctttaacctctagaaacaggatatgtaaatgctgaaaaacaaagtcccaaccagataagtcctgtgggtggtttcccagtcatgattcatggaaggagaaatgtactgatgagaaatcacatccaaaatattgtctctgcagtggtaatacttacaaagtcgacgcagtctcaggcggagctcactgaagatggtttccaagcttatatgtacttcacccatcccccaccctccagcccaaaacaaatcccaaacatactgcttagaactcagcctgcgcagcccagaggtacagagaggcaggaagcacccaggtgtccacatacggtgccattgtggacttgtagggcaggattccaggatatgggtgatgggcgtgtggaaccgcggcgccccctgcacagtgtggctcatttgagccggatgggggccgtgaaggcatcacccagcctgccccctgggagctggcttctcccttcctggggcggagctcgcccgacagccccacatgcctggttctccctgcagatgagggtgctgtgtggggtcacagggaagaaaccagcagcagcggcagagcttgatccaggcattggaggagggtcctggtacccctggcaggggctggcgggaagctgcacttctgtcattgcccatggcggctttggaggagatgacagagcatggcgaattctgcctcccactcctgacccctctgctgtgtcattcaagttttgtccttttcctactgtccgtttcgaacgtcactgcaggcagtggcctcggtggcttcgctccgcctggccctgctccctggctctgtgctaccctctctccccctcggctgggcccttcctctccgctgctccctgtggaactggagcccctcaaggtctcttcagtttctgatccggggagccctgcaggttgtcaggatgggttttgtgggcttattgctgctttccaggacctttgagaagccgtaagtctccttcctaccaggaagccctcactcaggaacgcacagaccggggtcaacaggctctcaggagcgccgtctgcgtgcaggtggagggtgtggcggggccaggagagcacttggccgcctttcatctcaacctctgaggacagaagggggctctcaaatccgcccatgcattgagatcttcgctcttcacagaggtgggattagtagcttagtctcagtttcaagtggatgaggttgtgtaatttcaagggaaaattacatccggcaatacctcttttgctaatggaactcaggaaggaaaggccctcagaaaggctggagtctggaatctaggcaggtagctggcctgacagtaaccttgatccaggtaaaccaaagtggaattctcgagcctggaattgatgactcataattgttttcatttaacagctcaggatgtgtgaaaaaaaaatgctgtttaatttgtaagacctaagtttacgactgattttggagaatacatttgtgataatgtatctatgttttcctggggtggcggaggaaatgatttctacctaaaaaaaagaaatgctagtagttaagactttttaagtgccacagaagcttgttctcagcaagtttgcttttatgaaatcaaaggatgaaagcctttgtcatggaagaagtcgtaatagaggatgaaaatgctgtcgggttatttttaacttctcatctgtttgacggaagtgcagttactggtgataggtgatgatagagtttgtttccttcttgggggagagactttgggcagtgtcaaaacctgaaatgacagcccagcacgccccgttccctgcttcctgtgctgtgcagagctcccccaggcctgcttgcaccccccacgtggggaatcctgaactccacaaagggatggatcactgcatgcctccttttccagatttgtactttggggcacagaattcacatggttcccagctttgcccacaggaggctacagaattaaatgttggcttagactatactgtccctccatgccttcaagaaagttgaatccttctggtaattggggagaaaaaattccctctgcaattcgtaggtatagccagtgttttcatgacttctatttgtataaatgatttccatgtttattatatcatgtaatctctaaaacaaccctgtgagcccaccaatactgattattaccaatgtatccatgaggaagctgaggcttagagctcagtcatgtgcctgaggccacagaagaggatagagcccctgtagtctggcactgggcttggacttccttccgcagagccaggggccctttcttttcatttttgagacagagtctctctctgtgcccaggctggagtgcaatggtgcgatcctggctcactgcaacctccaccgcccgggtttaagtgattctcctgcctcagcctcccaagtagctggaactacaggtgcccaccaccacacctagttaatttttatgtttttagcaaagatggggttttgccattgttggccaggctggtcttgtactcctgacctcaggtgattcacccgcctcggcctcccaaagtgctgggtttacagacgtgagtcgccgcgcccatccaggggcacgtttcttaacagcccctctgggtgctcacgaatttccggcatcagcaatccaccatcctggcataattttctgtgttttgcatccctgcctcccggtcataaacaaaagagtgacctcagttccatgcgagtggctgcttgtcccaagcagatgggtgtccggcgtccccgcctttttcaggactgtcaggtgggccctgtggtgctggagctgtgttcaggtgaacactagttgaggcttcagacagcttgtaggtgctcctgcgggcgcctgggctgctggcaggggacagtgcccgggttcgtctcgcagccagaggccagaggcaggccaggtgaggccatgctcttccctgtctgcacaccacactgctggcaagtaacacaaaacagagactggctaccccaaggggcaggaggcagcggaaacctgaggctcagacactagtgaggcgttccagctcagggccaaaatcagagccagggcagctgtggactctggctatggcgtctgtcgtacaagtgagaaacgaaaagaatgactgtcccgtgtcattcagcaaaacacatggtgtctttggaggtgaagagaggtgccaagcaccactcggttttcccagatttcctgtaggaggaaaaccacttggttctatgctgtggctttcacgccaggagctcctaggattgaggacgtctactgattgtatcacagtcgaagggcccagtgttacattacattgtgtccccaggcaaatacttacatttttacaattcaacaacgatgagcgaaggataactgtccaccattgtcagccttcccactctaacgtgtggaataaaatgctcatttcagttgattgtatcccgatggtactgctgtgtcagtgcagtcacgaccctttaaatgagttccctgggatttcacttttcttgttagacatcaccaggaattaataaccctccttttgacaatagtagtggtcagcagtaataacttactctgtgaaacatagagattacacagcatcatggggcttggctgcagccctcagtgcctgattagaataaagcaattgaggccaggcgcagtggctcacacctgtaatcccagaactttgggaggccgaagcgggcggatcacgaggtcaggagttctagacaagcctggccaacatggtgaaatcctgtctctaccaaaaaataaaaaattaactgcgtgtggtggcgggcgcctgtatttctagctactcgggaggttgaggcaggaaaatcgcttgaacccgggaggcagaggttgcagtgagccgagattgtgccaacgcactccagcctgggtgacagacagagtaagaccctgtctcaagaaaagaaaagaaaaaaagaataaagcaatcatgcaggtggtttcaaattccaaagctgtacagtaacattcaaatatggcaaggccctgccaggtgcggtggctcacgcctgtaattccagcactttgggaggctgaggcaggtggatcacctgaagtcaggagttcaagatcagcctgggcaacatggtgaaatcccgtctctattaaaaatacaaaaattagccgggcatcttggggggttgcctgtaatcccagctactcgggaggctgaggcacgagaatcgcttgaacctgggaggcagaggttgcagtgagccgagatggcgccactgcactccagcctgggcgacagagtgagacttcatctcaaaataaataaataaataagttatggcaagtccatgagtttgcacagccttccaggcctgatggaagtagatctgcatgtttggaaggattgcagatcatattttatctcataaatattaccagaacttcctcgtgtaacatgggaactttcaaaaccatagagaggagcattgtaaatctctgtggctcgtctccactgtcacagttcccagcttgtggccagcctgttgcatctgcaccttcactgtagttccaagggtcctttggaaggaatcctggacagcgtgtacttttcatctgaaagtacttcagtaaatgaaaggtggaattttaagtagactcttttttcattaatgtgactttgttactgagtgatgtattatagaaatttgtggaaacgtataattgtaataaatttgttggcttggatgctggaaagtaagactggcctcacatgggtgagctaaggtatttctttaatgtatccttttaaaagctaatggagagtaactgactttttcattgtggcccatttgagagaaaatatatctttctcaaatatttaaaaaggtcgatcacatgtgtaatgtttgccaagttgtatacacaagaaaactagaactcagaatcattaaataatttgctgaagtttacatggtttttaaatggcagggtcaggatcgaatatggggactgactctgaagtctatgtgtttcatagtatgctaaagagtaaatatttccagaatttcgatagagtacctaaattatcttgaggtggggttagcaaattgtgaattaagattgtggtttttgtaaaggaagaaagtgcctatacttttattggcaatctggtgtttttgtttgctttttttctgaatgagaaacaaaagaaatgaagagctagccatgtgttctctactctgtctcagtttgtatggctacttttccatccagagctcttgccttttggttctcaatttggttgcattcccatgaagaaaacctagtgtggcaggcagaaggatggcctcccacagatgtccacatcctgatccccagaacctctgactatgacactgtctgtggccagggaatcaagattgccaaacagctgacattaaaatagggaggtgattatagaactattcatgtggccaaaagtaaccacagaggcacttgtaagtggaagagggaggcagaacagactgtccgagctacgactggcttcagaggttgaaggggaccaaaggatgtaggcagcctctgcaggaagcaagaaaaggcaagaaaagtttctccctggagcctccaggaaggaaccagccctgctgatactttaattttaacccagtgaatcccattgcaaacttctgacctccagaacagtaaggtaataaatttgcattgttttaagtcacaaagtggaatttgttatagcagcataagaaactcatacacctgtcctaactactttggggatttataatacagactgtacggagattgacgcggtgtcaaaggacccgtgaccttgagacatgcccatagaatcatacacctgccctagccacatcggggatttgtaatacaggctgctcagagactgacgtggtgtgcaaaggacccgtgaccttgagacatgtccatagaaactttccaaactgaagagcaaagaggaaaaaagagtgaagaaacagaacagaactgtggacaactacaataggtgaagcaggccaggcacggtggtcacgcctgtaatcctggcgctttgggaggctaaggtgggcagatcacctgaggtcaggagtttgagacaagactggccaacatggtgaaaccccgtctgtactgaaaatacaaaaaataaaaattttttttaaaaaaattagccaggtgtggtggcaggtgcctgtaatcccagctacttgggaggctgaggcacaagaatcccttgaagctgggaggcagaggttgcagtgagccaagatagcaccactgcactccaccctgggcagccagagtgaaaactccatctcaaaaaaaaaaaaaaaaaaaaaggtaaaccatatatgcataatgaaaaaaacaaaagaagagagaagaaatatctccagtaaaagtggctatttccaaaattaatggcagatgccaaactaccgatccaggaagctcagagataaatacaaaagcagaataaattttttaaaaagggtacacctagacatatcacatttaaattgcagaaaattagactcagaaaaaatcttgaaagaagccacaggaaaagaacattttacctgctgagaaacaagggtaagaattatatcaaactttcttccagaaaccatctaaggaagaaaagaataatgtaaaatatttaaagtgttgaaagaaaaagccagcaacccagaattctgtatctcataaaattatccttcattcgtgaaggagaaataaagactttttcaggcaaacaaaaattgagcgaattcattgccagtagacctcccttgcaagaaatgttaaaagttcttcagaaagaaggaaaattatataggtcagaaattcaggtctacttaggaaagaagaacacagcactaaagtgtgagtttttgtgctgttacaacagaataccacagactgggtaatttatagagaagagacattgatttccccacagttctagagtctgggaagtccaagatcaagacactggcaggtttggtgtctggtgagggccccatctctgcttccaagatggctccttgagcactgcatcctctggagtgggggaaggctgtgtccttatgtggcagaaggcaaaagggcaaaggggcaaactccctctgccgagcccttttatacaggcacctaatcccattcatgagggaggagcccgcatggcggaatcagaactcttgaaggccccgcctcctgggaccgtgactagttgtcacattggcaacacctgaattttggaggggacacattcaaaccatagcaagaaggaataagtgaaggtagtaaaattaaatattttgcttttttgttgttttttatttcttttagagacgtgatctcaccatgttgcccagacgggtttagaacttctgggctcaagggatccactgcctcagcctcctgaagtgctaggattacagggcacagcacccagcttgcttttcgtgttcttaattggtctaacagagagtactttattcagaatgataatagcatttactcagtggtgattgctcaggggtgaatgaaatgtatgacagcagtgccctggggggcaagaaggaactgggcatgctgttgcgaggaatctgcgccacacacacagtgcgggttatgtgagagtgggcgtatattgtggcctctagtgcaaccactaagtaatttttttaaaaaataagtatagttgatattctaagacaggagagaaaatagtcacatcaaatgcttaattaaaacccaagatggcaggaaaagagtataagtcacaaaagaaacaaagactatgaagaaaggaataaaagtcagttacaaatatggtaaatattaatccagctatattaataatcactttaagtgtgaattgtctaaataaaccaaatacagaaactgtcagaatagaaaaaacaagacctaaccatatgttgtgtgcaggaaaggcactttaaatataaaaacacgggtttaagagatagaggaagatgtaccatgctgctactactcaaagggacacaagattagctatattaatttcagacaaagcagacttcagaacaagagaagttaccagggataaagaggggcattgccaaacaacaaagaggtcagttctccaagacaacataacaattctcaaagtctctgtaacaacagagggtcaaaatatgtgaggcaaaaacggatagaactggaaagagaaagaaaatccactgttatatttggacacttcatgacctctgtccacaggcagaaaatcagtaaggacacggttgaactgaacagcaccatcagtcccttggatctaatggacctttatgtctcacgcgtccatgtgaagagagtccaccaataggctttgtgtgagcaacaaggctgtttattcacttggatgcaagtgggctgagtccgagaaaggagtcagcaaagggagatggaggtggggcagttctataggatttgggtatgtagtggaaaattacagttaaaggtggttatcccttgtgggcaggggcgggggtcacaaggtgcagggtggggaggtcatgagactcattgtccaggggggaatgtcacaaggttgattgattagttggggtgaggcaggaacaaatcacaaaggtggaatgtcatcttttgtggttcttcagttgctccaggccatctgggtgtatatgtgcaggtcacaggcttagcttgggctcagaggcctcacaatttataaaatacttcattcaacaatagcagaccacacattcttctcaagttcacatggaacatttgccatgacagatcacattctgggccataaaatacaccttagcaccttttcaaagaatagaaatcataccaagtactctttcagaccacagtagaattaaactagaaataaataaataacaaagttaactggaaaatcccaaaatatttggagattaaacaaaacactactaaataacacatgaaccaaagaagtctcaagaggcataaaaatattttaagctaaacaaaaaatataacttatcaaatcttgtgggatgcaggaaaagcagtgcttagagggaaatttatagtattgactacatagattagaaaagaagaaagatccaaaatctacaagcttcaacattaggaaacttaacaaaaaattaataatcaacattagaacagaaattaatgaaattgaaaacaggaaatcagagaaaattttaaacatcaaaagctggttctttgaaaaaaaaaaatcaataaaatcaataaaactttagccaggctaaacaagaggaaaagaaaagagacacaaattccaaacatcagaaataaaggaggggcatcactactggtaacatggctaataaaaagattaaaaggaatatcatgaacagccctacacccataaacttggtaacttagataacattggccagtttcttgaaaaacgctatctaccaaaactcaaacaaggagaaatataatctgggtgggcctacatcaattaaaagaaatggaatccgtaattaatactcttccaaaacggaaagcacaagactcagatgttttcactggtgaattctaccaaacatttaaggaaaaaaaaaaaaatcaattctctacaatctcttccaggtaatagaagcggaaggaacattttctaattcgttctatgaggccagcattaccctaaaaccaaaaccagaaaaagatattaccagaaagacgatatcacacaccagtatttctcatgaacatagaagcaacgattctcaataaaatattagcaagtccaattcaacaatgtataaaaagaattatacaccatgaccaagtgggtttatcctaggtatgcaaggctgatccaacatttgaaaatcgactaatataacccatatttacaggctaaaaaagaaaacttacatgattatatcaataggtgcagaaaaagaatttgacaaaattcactacccactcatgtactgcagcaaactaaaaacagaggggaatttcctgagcttcataaagagcatctccgaaaagccctacagctgacgtcatacttaatggtgaaaaacgagatggtttcaccctaagattggaaaaaaggcaagaaatcccttatcactgttcttattcagcattgtactggaaatcctagctaatacagtaagagtagaaatgggaataaaaggcctacagctgacgtcatacttaatggtgaaaaacgagatgatttcaccctaagattggaaaaaaggcaagaaatcccttatcactgttcttattcagcattgtactggaaatcctagctaatacagtaagagtagaaatgggaataaaaggcctacagctgacgtcatacttaatggtgaaaaacgagatgatttcaccctaagattggaaaaaaggcaagaaatcccttatcactgttcttatgcagcattgtactggaaatcctagctaatacagtaagagtagaaatgggaataaaagtcctacagattgggaaggaaggaataagactatctttgttcacaagtgatatgattgtccatgcagaaaatcccaaagaaccaacaataacaaaaaaacttctggatgttagaggcgattatagcatggttgcaggatgcaaaaattaatcgctatcctatatgccagcaatgaacagttggaatttgaaattgaaaacaacactatttacatttaacccccccacccaccaaattacacaggtataaatctaacaagatatgtacaaggtctaggtaaggaaaacgacaaaactgtaacgaaatcaaagacttaaattaatggagagatgttccatgttcatggatgggaaaactccatgtttttaagatgtcagttcttcccactttgacctgtcctaatcaaattcccagcaagttaatttctagatatcaccaaactgattctgcatttatatggaaaggcaaaagacccagaatagcctcgcagtattgaaccaagttggagaactgacactagcccactttaggacttactgtaaaactacggtaatcaagacagtgtggtgttgctgaaagaatagagaaatagcggctgggcgtggcggctcacacctgtcatcccagcactttgggaggccgaggcgggcggatcacgaggtcaggagattgagaccaacctggccaacacgatgaaaccccatctctactaaaaatacaaaaaaaattagccgggcgtggtggtgggcgcctgtagtcccaattactcaggaggctgaggcaggagaatggcgcgaacccaggaggcagagcttgcggtgagccgagatcgcgccactgcactccagcctgggcaacagagcgagactccgtctcacaaaaaaaaaagaaaagaatagacaaatagatcaatgaaacatcatagagagcctgggagtagatccacccagtaaatccacccagatagtcaacccattcacccagatagtcaacccatctttgacaaaggagcaaaggcaattcagggcagacagaaaagcactatttcttttcaacaaatagtgctagaaaaactggacatgcaaaaaaaaaaaaaaaaaaaaacccagcaacagtgactctagacagtgatcacacaccgttcaagaaaattagctcaaagtgagtcatagacctaaatgtaaaatgtataataatgaaacttgtagaaatgtaggagaaagtctaggtgaccttgggtttggcaacaagtttttggataacaccaaaaacactgttcatgaaaggaaaattgataagttggacttcgtgaagattaaaaacttgagctttgcaaaatacagttaagagaattaaaatatgagccactgactgggagaatagatttgcaaaacacacatctgataaaaacctggtatcaaacaacacatggaaaataagggtgtttggatgggtagggcgggatgacctagggaggacatggaaagttagtttcttttttaaaactccagagactctcttctggagctccccttgccttttttattacagtcaacctgagatgggaactgaaaatatggccgtagttgtcatgaactggggggagccactactctgtttttaccctcattaaggaactttattgtgaaaggtaaaatcactttgtaaatgtgaattagaatagaaaatggaaattccttatatactctctaagccactggaaacttgaggcagagaagttttaaaagacgcacatggatttcctctgaaatatttgtaaacaccaaattcagaacatgttggttagtttaggaccataccaggctttagttgttacattgaattgtaaataacttatattcatgagcctggaattaaagaaattcttggtatgagaatttgacaactacttctggcttccaggagccagaacccaccttcgaatgggattttgaaataagccccgttgaagagacacacagatggcagaggccgcagcacaggctgtgagaccttcttcaggtttcggtagactgtcttcattacggcgtaaaaacatgtcagatgaaatttcagaaactatttccaaactcagtgaaggttcgtgacatctgggacgttgttgttttcaacacagaagttgaatgaaactgctacagaagcaaaatgagaagtgtggagaggagatgctgtggtggctgggcattctccctccttcccctccctcccctccttctctcattcccctccttccctccctgacctccttcccctccttctctcattcccctccttccctccttcctctccctcccctccctgccttacttcccctccctcccctccttcctctccttcccctcctcctccttcctctccttcccctccttttcctccttgcttcccttccttccctcattcccctccttccctccttcacctccctccccccatcccctctctgccctccttcccctccttttcctcctttcttcccttccttccctcattcccctcattcccctccttccctccttcacctccctccctgccatcccctctctgccctccttccctccttttcctccttccctccttcacctccctccccccatcccctctctgccctccttcccctccttttcctccttcacctccctccccccatcccctctctgccctccttccctccttcacctccctccctgccatcccctctctgccctccttcccctccttccctccttcacctccctccccccatcccctctctgccctccttccctccttcacctccctccccccatcccctctctgccctccttcccctccttttcctccttccctccttcacctccctccccccatcccctctctgccctcgttcccctccttccctccttcacctccctccccccatcccctctctgccctccttcccctccttttcctccttccctccttcacctccctcccccccatcccctctctgccctccttcccctccttttcctgtccttccccctgaggcctcaaagcccctgtgcctgagctgtggacaagaaacacgcctgcctcagaagctgcctggagctgggtgaaggcttccattcagctcgctgtcatgctctcactcagaggagagatcatgcagaaattactgaagtaaaatgctaatgtgttgagttaatgatcacaggtttacgttttataaaagacatcttaataatcaaactattgttgagctaccttgcgttttatcttgaattctctggagttaggtaatttacatacgtgtttcagagtacacactttgtttaagctgtcttagctgtcaacaaacactctaaattatgaattatgagttttatatctaaagctaaacattttgtactgtaaaatccagtgctacttactatgccctagagtaacactacaagagtaaaatctgatctcaatgatggatgtttgtttttcttttatgcagtacacattttggaactttatacccaagaatttatttgaacaattcagaagagtagccaacttttatttccttatcatatttctggtgcaggtaaggccggtcattgttttccatctcatcacatataaatctaaataagtgacattttattctcaggtaactgccacacggctaatgaaagagcaaggacatggtgcccctcacctatgattaatttatttattttcttaaggaagggcaaaatgtcttggttctgtgagatccacacaagctaaactacacacgacgctactttgggtttaagttggtgacagcctttcctgcccctttccttctagtaccagaggggaaatcagagctttgtcatcatttggacaagttcactgccaagctatgcatcgttacacttaatttactcttcctaagtgtgtgtggatgctctaaagaaaatccaggccgggcacagtggctcgcctgtaatcccagcactctgggaggatcacgaggtccagagatagggaccatcctggccagcatggctaaaccctgtctctactaaaaatacaaaaattagctgggtgtggtggtgcacacctgtagtcccagctacgcgggaggctgaggcaggagaatcacttgatcccaggagtgggaggttgcagtgagctgagatcgtgccactacactccagcctggcgacagagcgagactgtctcaaaaaaaaaaaaaaaaagagaaagaaaaagaaagaaagaaaatccaaagacagtacacatgaaaagagagtttaaaggaaagaaaaaaaagagtgaaaaaatatctcggggtatgagttagggagcaatgtgccaaatgtgttttaagaacagcactctaatttttctaaatcatacaaaatgctactgaaggactttaaaaatttttccaacattaaattattcaaatcatgtaattaaaatgtgacactgaggccgtggggtgaattaatacaaggcgtgccccgacttcagactgggtctgccactctcggtggtttccttgagcatgttccttaatttaaaaaaggtgccctcattttaacagtcagtgaaataggacgattgacttgctatctcccgtggtgggcagtcaggtgccagcaaaggtctttaaataagtcaaagcgaatgggaagtgctggctcagggcaaactaacctgcctgaagtcactcatttgtgtttttgaagatgattttacaattctctctttctgcagttgattattgatacacccacaagtccagtgacaagcggacttccactcttctttgtcattactgtgacggctatcaaacaggtaagcattttacagacgaaaaagaagcaatcgtcatcttcaccatgtgaattgcctttcattcaaagcgaggtgattggtttgttgtagctagttcacagaaaattcaaccaagttctagaaattcatttttataactgcgttagattgatacttgaagcgaaataagagatgttatataatttagttgctagtctggcaccatgcgagttcgagaagaaatctgtggttttcacatcccaaatcacccagagatgatctgatcagatgagtcacttaacctttctgtatccttgactgtcttgaccaccacagaacatgctgtttatggactccagcaaatgggatgctgttttttgtttgtttgtttttggttttgcttttttttttcatagccccagtaaataaggccagtgactaacatggagaagaatacatctcagttttactctctacgtatccattttatcacccccagattccctgtacacgtgttcagtccctccccattttctcctccccgtccctggcaaagactcatgtttctgtcaccgtagagtcgcctattctaaacatttcgtactcacggctcataggcggtgttttgtgactggctctttcactcagcatgatgttttcaaggtttctctgcatctgagcaggcgtcagcgcttcattccgtctgatgaatgagtcacggtcccctgcacatacctggcattttgtgtatcacgcgtcctctgtggatggacatttggggtgtttccactctttggctgttctgaataatgctgctgagaacatttgtgtttcacacccaccagattggctttcagatgtgaaaggctggagagggcatggcgagggaggcaccacgggccgccggcaggagcgtggcggagccaccaagcacagcagttggcaacatctgacacaggcagagatggggacacacagggtccagtgcagatgataaacatgcagctgtgcagtcagtacatggggcctgtgtgtcttcactaggccagagccggccgtgcctaccgggatacgtgaactaggatattcatggtggctgtcattgattagcaaaggactcgggcaacctggtgtccctccgtaaggaaatggacagctccgccgcggtgcatggcagaacacagcacagtaacgaaacgaactgtgctgcctggagaacagaacatgagggagactcacgcttcccaaggacgcgctgcctgtgactcaggcagtttaactcctacctgggataaggcctcacttcatgtcggtggcaggctcttgcaaacttcaactttaagcaaaacgatgggttttctcatcaacttcacaaggaaatggtgctgaaggaaacgatgttactcggggacctgccatgtgtcctcgggcccaaagtcacagtttccaggaacccatcgtggagattaggtgagggcgtcccgtgctatctgtgatacatctgtgtggtaggagcagaggctgcagacaggaaggagacccctgagcctctcaaggggagcagagagaaggggcgcgggggtgcagaacaaggggctgaggctctatggctctgttctttccagcctggccccaggaggcaggcgtagcactgttcttcagcgtcctcttctctgcatttgttaaggattccatccctcccgggactctactgagcaggaaactcctgagatctccaggagtgtcctggaggagaggagaggagagcgtggagtagggagggcggctctgaagacgcatctgggccagagaggcagcggccggggagcccgagcccccatggatgcagaggctgcctctctacactgtgcagaccacggccccagacaacatgtggtgtcctcggcccggctgtgccccatccctggctgtgtcccctcccatcggcctggctatgtcccctccctggctgtgtcccctcccatcccagggcagtgggcgggcgttttggggatgttaagagggggtcagggcaaggcggcaaatgaacagagctgcagttctgggccccatcaccagcacccctgcctctgcccagaggggtctcttcctctcccgcgcgtcctgctacccagctttcactctggggatggccttgcttcccctactgctggtctggacctgtgtgtgccagagcccccccaccccctcgaccttcccccactactgacctccttgtccctcttccttgggaacagcgcctctgtccgcagctgggactttcccaaatggcctccccacactgtggctccagcagggctgtttgtgctggggtccccatgctcccggcccctcctcgcttgccttggaaagccccctgcactcacagaggcctccctgattttctcttaggtccccgcctctcttttcacaccatctccccgctgtctccgctgggcactgacgggcatctcactgtacctggctctgccgccgccatcgcccaggtcctgccagagcggcctttccctgtggcacccagcctcccctgctatgtgcagggcccctccgatcagcccatcacatgcatgggcctccacgtgtccttcccgtcccagccaggctggctggtgggcagtgccagcccctggggactccctcaccgctgggcattcctgggcacctcctctttggcgtcttcccgcagcccgggcgctaggcttttcggggatcctgggtgtctctcacctgcattgaacttgcagttatttctgtttcttctccaccaatcctgagagcagcagctctggggacaaggtctttcgtctgtgggcccctggtgcctggcacttgctgagcatgcagttggtgctaaataagtgtgtttaatgaacccaggaatcatctacccactgccaccttccaggaagactgttcttcagtttccccagaaagagagtatttcagcgatttgggaggaatctctgaaaagcaatcagatgccacagtgtcacttattaatggtcacagctggagaaagctcgcacgtttggatatccatgcgtcccaggcttcttaattctccagaagctggaggttttgggttacttgtttatgctcccttcggaggagactccagtcacagggccactgatgccgccacgtggcccacagggaggaggtccccagtgagcctcctgccccacaggctcttgcaacctacctgcagcgggcccgtggcacaggcttcctgccgccatcctgtgtggttgtgtgtctcagcacacatgcagtgggcccgtggcacaggcttcctgctgccatcctgcgtggttgtgtgttgtgtgtggcagagctgtgtttccaatttcgacactcattagatgcggtggacgtggacgcccataggcccctggtgtgcagtctctcacatgctggggattgttactgagaacggcattccccatccttatctaaggcacctgcacccagcaacgccaaacacaaaggcacgtttgtcatcccaggaatcatctgtgtgcagcatctcctattgtcgcttctttcaagatgccacctgactgtccaaccagagggtgtgccttcgtagttggaatcggagtgcacgtgtctgcgccagtggaaggcatccaggtccgtcagcgcggccggggtcagggttagctcaggctgcttttccagccccctgcctgtgcgtgcacgggagtcacgatgggatgtttcccgcgtgggttactcagatgcggaaacgcacagagagccttaaggctgctgcgggtgtcacagagtgagccggcgtttcaccgagagtctgggctgccagatctcataacaatcagtttttaatgaaagagaagaatggccagtgggggcttttccaagtggaaggttgacactcagcgggtggaaatgtaactggctccacgtcttcggggcttttcggtgtggatgtgaagagcctggaaggcttgctcatcatttcattcagacacttcttttttaggaatttatcctaagtccatgtcatgaataggcacaaaaagtacagttgtatagtacttatacacacttcgatgagcatctttctccaacgtcttcgaagttctacaactgcagacatttaaagcagctcgcgttgccatggaacatgccgatgctctgtcaaggatagtgtgtgtagtgcatcctcatgctgaaaaatacacccccacaggcttggattatgcttagacataattaaacacaagccttctgtctctccctccctttctcctccttccctctctccctgcttcctctctcccttctttccttcctttttttagggttatgaagactggcttcgacataaagcagacaatgccatgaaccagtgtcctgttcatttcattcagcacggcaagctcgttcggaaacaaagtcgaaagctgcgagtaagtgacacccgacacatttacgctggtgaagtccagtaactgtttaaaaaataagttttacccaggtgcagtggctcgcgcctccagtcccagctactcaggaggctgaggcaggaggatcgctgagcctggaagtcggaggccactcaggaggcttcaccgtgcctgtgaatagccactgctctccagcctgggcaaccgagaaagaccctgtctcttaaacatttttaaaatacaaataataaatgtttttaagtttttattttctttggcaaaacagactgagatgttttttattgggtgtaggcccaagctccctacttcttttttttttttttacctttaatttttatttgtttatgtttaatagactttttagagcagttttaggttcacagcagcattaggtggatgtacccactgccccttccaacacacacacacacacacacacacacacacacacacacacacacagcctccctctgccagcatcccacaccaggattggtggaatataaaatcattatcactgcccccatccccacacacaccctccctctgccggcatcccatgccaggattggtggaatttaaaattattatcaccacccccatccccacacacagcctccccatcaccagcatcccacgccaggattggtggaatttcatcccacaccaggattggtggaatttaaaattatgggaacacacgaaccaatcaagacagagaaagattggaaacactgtttctaaaatttgttttagaataaagtataataaaatcatatcaatataaactcgactaggtggaaatttatgaaaattggaacagaaaacttcattgaagattgcatttttttaaaaaaaatgtatttatttattttttaagagacagagtcttgctctgtcacccaggctggagtgcaatagcataacctcagctcactgcaacctccgcccccgggttcaagtgattctcctgtctcagcctccccagtagctgggattacaggcgcctgccaccacacccagctaatttttgcatttttagtagagatggggtcttaacaaaatgttggccagactggtctcgatctcctgaccttgtgatccgcctgccttggcctcccaaagtgctggaattacaggcataagccaccgcatccggccaaaaaattgttttttattgatgtataatagttgtacgtagttgggggtccatgtgatattttgatgcctgcacaccaatgtgtgatgatgaagtcggggtaactgggatgtctgtcacctcaaacattgattctttgtgttgggaatattacagttcttcttgaaggctgcattttaaatctgtttcaaatgaattatctgtgtaactaatatctcaatatgtttcaaaatatgtgattaaattatttaaatgagatagtttcaagcttatactagtcatttggaagcacctttataggtagaaaccatgagtgtggtttttcacgtttgtgtcaaggtagcggtcagcagcctgctccagtcccccatctgatgtggatctaggtgccaggcccacaccggccccttcctgcccccactggtcctcgtgcaccctgcctggctctttccaactcccacgcctccctccctcgtgcagccccactgcctccctggctgttttcccagctgagccgtaggaggtttggtgagggaggcagggagcaccccagtcctgtgcatgtggagagccaggtgcgttccagaagcctggagggagggcctccaagcagcccagccagcctgggctcagtgaacctctccggacaaggccgcagcccttccctgtccagtgggacgggaccccaggaggcactcagaggcccttcagaggagccagcatcaaccactaaccccccaccgctcaccttgctctcactgttctgtgtatcacacacgtcaccaaatgtacttttaagcatttaaacattttcacttataaacgtgctatccaggtgtttaaatgcttctgagacagcttttcccttcagtgagttcagatgagtgatgtttccctagaggtcgggggttcagagagcagatggccctggcctggggaacagccgcgagctccatgcctgtgtcagcaggcatccggtcccaggccttcaacgccatttcctttaatgattatatttcccttgcaaagccttcatacttgtagctaaacatctttcttaaaaaatagacctaaacagtgtctgcccacagaaaattgaatttttaatgtatcggtcttctgtgggaaatgccagctctgtatcctgtgtgtcgtaaccaagaggatgctaaacaggctactcaggacgagaaagaaaagatcaggcttttcctacaacggcagacatccagcttccatcggtcgtaatggctcaggcctttgagagtgctagagcgtcctagaaaagcagtcctttaattagtttttcttttttaattaaactttttatttcgaggtaattacgggatcacatgtggtagtaagaaataaaacacaggcatcctgtgttccatttgctcggatgtgctgcccagctctaagattttgtcatctcaaggatatgatataaagagaatcctgcagcctgtgaccttttggggttggctgttttcaggcagtctaattccctcgggattcacgaagtctgtgcaccagccattccttcccttgtattgctaaggagcgttccatgatgggggcgtactgcagtttcaccattcacaagttgaagggcttttcgatttttctagtttggggctgttatcaagagagctgctatgaatatttgtgtgcaagttttcttgtgaatttagttttcatttcttttgcataaaagctcaagagttggattgctgggtcatctagcatatccacgtttggttttgaaaggaactgccaaatggttttccagcatggccatcccatttcattcccacgcacgacgttgccagcatcttcaccagcactgggtgttactgctgttcctgatgtctcggtgcagcttaaatatgtccctgacggctctgtgggacatcttttcacgctcgtttgacatctgcatatccttgtcagtaaaaataactcttcatgtcttttatccatttttctagctggattctttgagcttctttttactgttaaatgttgagaggtcatataatctagatagtaatactttgtcagatatatgatttttaatactcagcaggatatttcacaaagcaaacgtttttaattttgttcaagtccaatttcttgattttttttttcttttttttaaaattattatttcttttgagacagagtcttgctcttgttgcccaggctggaatgcagtggcgcaatctcggctcactgccacctccacctcccaggttcaagctattctcctgcctcagcctcccaagtagctgggattacaggcgtgcaccaccatgcctgtctaattttttagtgttagtagagatggggtttcaccattttgcccaggctagttttgaactgctggcgtcaagtgatctgcctgcctcggcctcccaaagtgctgggattacaggggtgagccaccacgcctggctgattttttttttttcttttgaggactgtacgttcagtgtcctgaatgaagcattctttgcctggtcctagacccaaagactttctcccatgtttctttctaaaagtgttatagtttcatgttttacatttaagttcatgatccattttgagatgatttttgtataaggtgtgaggtttcagtcaggtttgtttctgtccttattattttgcccgtggctgtcttgtcgcccctgcaccaggggatggctggctgtcccttttccacggagtggcgcttgtactctgtcccagtcagttaaacacatttgcatgggtctgtttctggttccctggtctgtcccattggtctccatgcccatgcccaccaatcccacactgttggtcactgtagctgtctcagaaggctggacattggggatacgtattccttccccctcaatcttctttttcaaggttgttttagctattctagagcctgtgccttcccatataagttttagaattagctcatttatatctataaaaatccttgctgggattttgatagggattttactaaacccaaaggtccatttgggaagagtaaccctctgattttaaagtctcacaaattcgcagtgtgctgtgaccatcgtgtagtgggacagagacctctgtttgcagtgtagacagaagcaggtgacgccctgatcctggcatgcctcccgagtggcagtgagactggctggagccctgcagtgactcactcaagggttctgatgatcgtttccccttcagacatgcagcccagatctgcaatggcttcctcacccttcagacacacagtccagatctgcgatggcttcctcacccttcagacacacagtccaggccactgagatgccttcctcacccttcagacacacagtccagatctgcgataccttccacacccttcagacacacagtccagatctgcgataccttccacacccttcagacacacagtccaggccaccgagatgccttcctcacccttcagacacacagtccagatctgctatgccttcctcacccggcagacacacagtccagatctgcaatgccttcctcatccttcagacacacagtccagacctgtgatgccttcctcacccttcagacacacagcccaggccactgagatgccttcctcactgatgaaataaaatggatacagacacaaactagaccatgacctttaattaaaaacccacatgatcaactttctgtgattgatttttactttagtttttgaaacattgttgccacttttgctttatttgtcctcatgctttgatgatctgggcagcgccttggttctgttgatcaggaagctctcagaactcgattacctggttcataaaacgcctagatttagatcaaagcttctcacaggagtacttcccacttggccacgctcacagaacactccaactcgtcgtcttggtctgaatcaaagataaccttgttacaggtgtttgtctgtgtttttgctgcggaagttagaacattgaaacctgacctggtctttccttggtcccagcagaatgtctggcaagagtcttttcctgaaaccgtgtccacatccccgtgtcttcctgtgaatagatgagcagcttgagggaagcggtcccacaggacgggcaagctttcacggaggggctttccattgaccatcctttctgctttgtcctgtaggttggggacattgtcatggttaaggaggacgagacctttccctgcgacttgatcttcctttccagcaaccggggagatgggacgtgccacgtcaccaccgccagcttggatggagaatccagccataaagtaaggggccttttcattagactccagggcaggatcttcctgtcctgcttcggactgtgcccatgcggccacagaaactaacatcctgtttgaaaagtcaccgttttcatgtaacccagggagttacaccagccatgtttttcctcacttttccttcctcctattttccactttcttctttttcctttttaaaaataaattgtattgtgtatatttgaggcatatattatgatgttataagatacatatttttatagtgaaattgttattagagtgcaacaaattaacacacccacatctcactgatttcccattctctcccctggcacccatgcaggagcagccataacctactcgatgcggcaaaaccctgagcccagcacgctcttgtccactcagtgcggcaaaaactctgagcccagcacgctcttgtccgctctagtcctcgtgttgtacgttgggtttttggacagttcatcctaaataatgctaccttgtgttttttgacctacacctccccatttccttttcactttttctttccagtctcaatgtctgtaacaaccaattacctcaggttaacaaaaataacttcagtgttaacctgtgtcaattagctaatgtaccaaattcaggatttaatgaatagattgttggaattttaagaattttcattttattagttaaaattagtgtgaaaactggcctagaattatgtgaaaagtcacacacgattctagattttgcctgttacttcaatgagtgtctttttgtgaatgtatcttagtcaggattttctgaaattactacataagtaatttcctgcactcagtataaaattctgcacaggcagttgatgctacaagaattttaattgtcaatcatacaagaaaagatatagcaccattaattttaagattcttcttatttaaaaaatcttgaagtttctaaggagtttatgaaagtgagcatagctcagtggattcaactaagtcatcagctcacaaaattgcaactctaaaatggtatttaggtaatacgtatggatataggccatttctactatgagatagagacattttctttacaaaatcactgaaggatatgctagtctttcatagataattcatgatatgtatcatgaattgatagatgaaaaacctatggatctttttcagttaaattagctttcacattttctgtgtagcatatcccaggagaatgaacacgctaacctaaaagattgtcagcagtttctagggggtcggaatccctggatgattcaggtattcgctgtaagcgggtgttggtccctctggaacctgggaggaggttaaggttccatccacccagagaccctgtgagcccttcacactctctgcagccagtcgctgcctttacaccccttccctgcagactgtggctggtcaggctcagatgagtcccagccatgctagtgaacagatgctgtgggtctccagatacaccatgtttgtccagatgaaatgttgtagcagttgtggaagatgttaaaacagctattgcactttgaccttttgtggctttgcagtttgcattatagttttgtgttctctaatgtcctttttgtgcattttgtttagcttgagggactggaattatttgagccctttccttaaaagcagagtaggggcgtgggaagggtccacccgacctctgtttggatcccgtggggctcacgtgactgcacaggcctgttcacttctctggactcttcacatttgtgaaatggggacaaccctatctctcaggggctcttgtgaggataagattagaaaattcctactgaatttagaaaataagcgccccctgatttgtgtgcttggtgacggggcagtgactgttggtgtgcttggtgacggaacagtgaccgtttgtgcgcttggtgacacggcggtgaccgtgtgtgcgcttggtgacagggcggtgaccgtcggtgcgcttggtgacgggcagtgactgttggtgcgcttggtgacggggcggtgaccgttggtgcgcttggtgacggggcgatgaccgttggtgcgcttggtgacaggcgatgaccgttggtgcgcttggtgacggggcggtgaccgttggtgcgcttggtgacggaacggtgatcatttgtgtgcttggtgacggagcagtgaccgtgtccccctgatttgtgcacttggtgatgatgcagtgattgtttctcccatttgttctgactcctgtgttttatttgtccaatactcttccactagaaagaaacacaggaagggattcagagatgctgttgcctcttcgcagatccctgggcacaagtttctcctctctcctcccaaggcagggccggtgcagccctcatgcccacctcaggtgggccttcagccgacctgctggtgctcacagatgctactgaggtcaccaggcctcaaaatgtgttctgagagcagcagcatcggcatcactgggcaccatattagaagtgcagttctcaggccctccctagacccactgcatcagaaactctagggctgagcccaggaatcaggtgcttcagaagctctgggtaaaactcacgttgagacaggcttgaggagccccccggcccaggccatgtgaacagttaagtagaaggcctgtgccacccaacagcaacgggcacaggcaggttgttgccgagaagtgaaaatgaagtgaagtgatcctgtgaccgctccccgtaaacaacagggcgttctgtaaaaggaaagggatatttcaggtcctggatttgtttcctaattaatagctactactatgacagataaatcagtgtctacccttgaagaattcgagcattgctatctgtcctgttagttttaagtggaggacactgggtaagaatggaaggatgagaattttctggcacctgataggtgcaggaataacagtagtaccttatctttctgtaactattaaacatttacaaactcatagggtcagccaggctttgtaatcacttggttggaggcaccagcgtctgggtttgtgttgaccgttttggcggtgagctcacatgtcttgtgcatttgtagacgcattacgcggtccaggacaccaaaggcttccacacagaggaggatatcggcggacttcacgccaccatcgagtgtgagcagccccagcccgacctctacaagtaagcgggagctttgggttctttagaaacggttttttatgccctcaacattgctcttgctttttcaccccaagtagtccagccatgtggtggtttggaaagagaatgtaaatcactgcttaaagattaagactgagtcaaaaatacattacttatttattctcatagacttgtaccactcagatttgtagctttttatacaaatatttgaagtggcttcgtggaaccatatttgtgggaaaaaaaaagaataagttttctttattttacggaagacgtttgtaaactgtgggttaaggaaaatcaccgaagccatgagctgatcagaacagaaagtacgacaagggaaggggctggagcggggctgctttagccgcacacggagcgggccaggtgaagacgtgtggctcacagaaggcaggtgggccaggcgcgcgcttcccgggggccgctgggcgcgtccggtcagtaacgtggcttttctgtcgccaggttcgtgggtcgcatcaacgtttacagtgacctgaatgaccccgtggtgaggtgagtgcctctgcggatgccttggccacggtcacctcccttgttgcgttagaaatgcattctttgacggacaagggtttccacggcggctgctctggtagatttggaaggtggagttccgctttcccacagggccgggctccactctcgtctctggtttgtctcaggcacacatctgtgaatgttgacaagttagtgatgctcgtgaaacaagttttcgcgcaagactctgccgagagggtcgtctcacaggccaggaggcgtcagggtcccgtggagcagtttcaaagtgaagggcggagtacagcttccctgggagaaatgccctttcatgattcgggtactgatttgtcttcagatatgaaattgaaagacttctaatttggaggccgtttttgggaatctgttcatccactcaccatcattctggggtgcattactggctcaaggcctatctgaggctcacacctacctgagaaggtggaatcggtagccggggcaaggccgggcagctcacggttggctgctgtgccttcccattcaccagcatggacccagcggcagtcacatcgcatacccatgaggaaacagcgaccctcagacacctcatctatggccccgaggcagcctcggctgagagccagcctgtgctgagcccagctctgagcagcacccacctcccaggcctagggatattttctctgacattatttcaagatctagcatttgttgctgacgagatatttgaatgtcacagtttagggaattggctttcactggattttaaagttgcatcttcttcataaactccacttgttagggaaatgatttttcttccattgtaagcactctccaagttgttgatgtctgggtaggtacagcattgtgtgttaaacaacacatctcccagacacagaaacacactcactgggaaactactgcaaagtgaatagttcctgaaatgcttagctccttgtaagtctccaggagctactgttttaagaaaaccatttgtgcacttcttagcatgtgcttgttatcattacccatcagcaggctaggaggtgctttcgagaactgatagtgaccttgccttggtttgcctacgtatatactgttctaaaggtaaattcctccttactttggagaaatctcttgtatttctgtgtgccgtgagaattaatttgtgtttgaacagacttaggcttattcatattacctatgggatgaatccaaaatagtaaacattgcaggcttttcatctttatagttagaccaagtttattgctgaacaacttgggacgataattgctaatgtattttgcattttgatactaactctggtttcacttttattttatatattttattttattttattggagacagagtctcgctctgtcaccagtctggagtgcagtggcactatctcagctcactgcagcctccacctcccgggttcaagcaattctcctgcctcagcttcctgagtagctaggattacaggcgtgtgccaccatgcccagctaatttttgtatttatagtagagatggggttttgccatgtcggtcaagctagtctcaaaacgccctcaggtgattcacccacctcggcctcctagagtattgggattataggcatgagccaccgcgcctggcctagtttcacttttaaatatttatggtattccatagacttttaatatttagattattgaagatgtttgtaaatttgtgatgtggacagttaagaattacgcacccaaattctcaatccattcagagtgacgtttcttcttccttctgtcctaactagaagcaaagtacttttccaagtaaattatttttagacttccctgagtcactttttaaaaacgctgtttgttttcgtaaacacatggcaggaattattataagtgtgttgcaaacagaagctgacagtccttataacacagccagacaacccatatgcagcctgggagctccatctttagtgattgccggggaggacgcgcgtggagccctcagccgcagcctggggtagacagccccactctgcctgtcttcagccggatgcagttctgaggtctatcgaccaaatatactgcatgcattttacattcataatattcagtaggttcttaattttccatgatagaaggacagtaaatacaatgataaatgaaaagcaaacttcagcaaacacttttgaccctttaccctctgaagcaatcctctgaatgttatcaatagcaaaatttatacatttgaatcttgctgcttatttctcccttactacttaggaaatgagaagagattatttttccatcagcagggaaccctgttatatcaagaatataagcccctgatggcagagaccctgcctgctgcttatgtggcttcagtgcacagaacggggcttgttcttccatgtgtgagatttttaagttctttggctgttgcttgttttccccccaaagcagccatgcatggattgtcccagatttacatgtcccccccattcagaggagctttgcagtgtggctaccagtgtttctaatggccagatagagtatcagcctttgtctccaggaataagactgtgtttcatgggactccctgaatctcactgaggatgtaatagaaacaattgaggctgggcatggggatgcccaactgtaatctcagcactttgggaggccaaagctcaagttcacctgagcccaggaggtcaaggctgcaatgagctatgatcgtgcccccagcctgggcgacagagtgagaccctgttgcaaaaaaaaaaaaaaaaaaggaaacagttgaaagttgagtgacttttattttatttcacatccacccctctttagcctttccagaacattctgggaccttccagtgcagctgttctcaacctgaggcttgttaggagagggctgctgggccccaccccagggtttcaggttctgactcggtaggcctgggacgatcttcctgactagtgtgatggttcctgactggctccaggtgctgctgacggcactggtggggccacctcagggacccctgctctagaggtctctcggggagtgttgctgaggctgccgggcgcagctcagtgggtctggatggggcctgaggtcccgcatgcgccaatgggaggcccttgccgctactcctggagccatgtgttcgtcccccaaagataagcccacatctgttcacatggacctgggctgacttaatcatctgaatataagcaaacctccgtgtatgccatctcctctgaaaatgagatctgctgagcaaacaagtgggtttcacgtctgcctcttgccccccgccctgcccacttgccttcgtgtccgcatcatttctgatcatcgtatctttacaggcccttaggatcggaaaacctgctgcttagaggagctacactgaagaacactgagaaaatctttggtaaatatttaattaattattaaccattgcccctaacattaaggatgcatgaagcaaaagttaaaacccgcagcggaacccgagagcgtttcttggcaccttgaggtgctggaggctttctggccgcgcaagttctgccccactgagatttgatcagtgaataagtgcaatcctgaagcagcagcatcagagaatacggcttacggattaaggcctctagttttggattcagaaacagaacattgcatccgtgaaggaatttgtgaagtttagttgtgcaggaaatgtttttcatgtctgcgtttcttgactaggatctcccatttcttgtgggttattgtctgttttaattgaggtaacctttagaagtatacaagtgtgccccactgtcagaaaatgctgtgcaggtgttcctcagtgtccttgggggactggttccaggatgcctgcagatgccaaaatccacggatgcccaaggccctatttgcatgtagcctacgcatgtctgcccctgtagttcacatcatcttagattacttctgatacctagcacgatgtaaataccctgtactgtttttatcgtctgtattttgtatcattgtattgttatttttattggggatttttttcaaatattttccatccccagttggtagaacctgcagattaagaactcgtggacatggtgggcccagtgtatattaagatatgaactcttaaaaaatgaagcatagattgcttcctatgcatgaagaagggtctttatcctaaggaatcaagtgctagtgttatgtggctatggacactagcttatgaaattaaaaataggattcgctttacccaagaattgattttccccgcagctgtgtgtaactcaccataaggcaagacacacttgcgccctggtcatcacccttgctcttcctctctgtaggtgtggctatttacacgggaatggaaaccaagatggcattaaattatcaatcaaaatctcagaagcgatctgccgtggaaaagtaaggctggatgcgcgtgagaacctgcaacttaaaagtgtcattacccactgtagaaatggaagtagcttcctcttggccttattggcagttcctttgccactgtacagcatcttagtaactgcagagctgaccattcagatggtctttcttattttgtggtgaggtggatggccacacccctccttcctgctctttctaacgcctgataccaggttcacagcgctgcctcttacggacgccctgacgttccggttctgaaatcagttcagtatccaacagctcctctcaccatttcatgaaaaactccaaatgggcttacttttaactctgggatttggtcaaaaccacgtattctctgctatggttttacaaaggaaagcgttagcagagagaacagaatcatcttttcattaaacagtaaagtcctgatgataaatatgtcaggatggtagctgaatttgtgctggaaaagaaaggcttcttcctgagatctgctaagaccttagttaaggatctgtgcttttcctgtactgaggacacttcctttcagagttatttacttttctccccctcctttcctccctccctctcttccttcctctcctttccttccttcctctacagtggtgggtagtcactaagttttgaactaatttgttgatgcttaatggtagaaattgatttctggatgtacttttcaatgacggaagtccaggcagtgcagaagcatggtccgcagtgtggctgtgagcagccctctctctcctgcttgtggcactttaccccgtcttggttcttacctttgacctctagaagtacgtgccagggaccatggcatggacgcaagtgcagaggacccaccgtggtgcgttgagggcgaacacatcactgtgcccttcctattctgtttcttcacgaggtgtcatcttgatatctgtgagaaggaagtgcagagctcatttcctcagggaccagtgatcacctctgtccttttgttttagatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctggtatggagaatcactgcccttgtatgatccgaggtgacctgtgggccattattacgaaaatgtggtgcaagaaaaagatgacggtgaatttactgtaggcaaaaagcagcttgattgattcagtctctgtgatagatgcattcactgaaatttaaagtctcagtggacaccagctgctcctgccatctttggatctggaaaggtacaggttcccacagtgaaatcatcaggacaataccttaaatacttgcactgtgtcctttgtttagagagtgctgagaaaatgcttgttaatgattatgagataaatggcacatatttgtggtaaatacttggaaaaaagggtctgctcccagtccagagcagggccatgtgcaaaccgagacctgtgtccactgagcctagagcaggactgtgtgcaaacccagacctgtgtccactgaccctagagcagggccatgaacaaacccagacccatatccactgagcctatagcagggccgtgtgcaaacccagacctgtgtccccactgtccagagcagggccgtgtgcaaacccagacccatatccactgagcctggagcagggccgtgtgcaaacccagacctgtgtcccctccgtccagagcggggctatctctgcatcatctgtccttcccacaaaactaacatggccccacagatcaggataaaagtatactgaaaagtcatttcaccaggcttagtttttacatctgtaggttgttaccaagtatgttttgttataagagacacaaagagatcccatgaatatgcagaagtaaaattgccgctggtgtctggttggcgtgtctcctgtcatcggcacatgcttgtcttaactcgtgatttaatctccacttgctggcaggacagccccacagctcagcccctggacccggcaggtcctggctcagagaccaggtgacccagtggctgccttccgcccatagtccttgtctttggactctgaaatcttgtatttagtagtagcgctcgtataacttatgcctaagcctgaggtgttagagcagcatgttggaggcctgctgtccctcctggtggaggtgctgacccgcaccttctgctcttgcagttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggttggtgtctcctgagtcatctgctgtgatttattaacatctgggtgagtctgcttcacgttcctcaggtcctgtgcctgtcatccgagcgtggctgtacctgtagctggcgtaagacagcagcagggttgttttgaaccctatttatgaaacagtcagccgtgctgttacatttacaacagatgcagaattacctgcacttgctgactcctggaaactcattggagcttcctgggcagaactctttctgtgtgcaggtgtgaatcaaggctggtgggtaaaagtggctttgccagccttgcactctgcttctgcacctgatattcaagtctcatggcgagctgggtattttcactttaaagatgaacaaaccagattttcagtgacttggtggattgcaaagagttcagacgcctccattcagatcctgctgctgcatgatggctgcgggagctcgggcttcaccgccacacctcgagtgtctcagtctgtgaaatggagatgataacagatgctggccttacaggattgggttgcagattaaatgagataatggacacaaggtgcacagcacagagtctggtgtgaccaccgccctgccaccgcaccaccgggaggcacacaccagacctgctggcttgaagggagctagggaaagacccattccctgggtttccccagcctagagcggtgaccttccctaccttcccagccttaacgttgcagagtgcagggttgccggagcaggtaccagtaaacggtaattggatttttcggaagaaatagcgattttgaaggatattttagcaaacaaggccactttagacaggtagctgaaatctccatctcgctcccagatgacagcctgtaaatagacttagactctggcagatacagaggcctctctctgcctcctgtgaggaaggccaacaaacggaaggatcatgttccacatttgatgagtttgacttttgaatgtgttcctccagcatgtcccatactcctcacagtgctttattgtttgagtcagcaatgcgcaaactataatttagttgttcaatagtcaggtatttttatctaggaatattctatctcctttgcaacaatagatggtacattttgtgagcttctgataaattctttgggaaagaacttttttctgtaacaaggaaagtgcccagcagcgttgagtgtgggggaaagcgcccagcagcgttgagtggggggaagcgcccagcagcgttgagtaggggggaaagcgcccagcagcgttgagtggggggaaagcgcccagcagcattgagtgcgggggaaagcgcccagcagtgttgagtgcaggggaaagcacctagcagtatggagtgggaggaaagcacccagcagtgttgagtaggggggaaagtacccagaagtgttgagtaggggggaaagcacccagcagtgttgagtggggggaaagcacccagcagtgttaagtaggagggaaagtgcccagtggtgttgagtaggggggaaagcgcccagcggtgttgagtggggggaaagtgcccagcagtgttgagtaggtgggaaagcgcccagaagtgttgagtatggaggaaagtgcccagcggtgttgagtgtggggaaagcgcccagcagtgttgagtaggggggaaagcgccaagaagtgttgagtgcgggggaaagtgcccagcggtgttgagtgcaagggaaagcgcccagcagcattgagcacggcagatttcttctctgccctcttcagtccatctccttggagttctgcaaaacagaatttaatttctgttgttctgtcctgaccaaaaccaggctccagcttggaggctgacctcctcgtacacaaagaagtgtgtactgttgctcacgggggacacactgaggtcaagacgggtggacaagcccaaaaggcaggttcatctgaccgcagctctgtgggtaaacgcctgtgcccactgtcgctgtgcagtacgataacacgacttcttttgtatgtgaaatagattcacccaccagtcaagcgtctgtgtccacaacagaaacaaccatctgccatggagatcctgtgccagaagcacttcgtgcaccttctctgtgtcctgtgcacactttatgcaccttctctgtatcctgtgtgctcagtgctattgcgccgtttctcaaatgagaaactgagtcaggagcaggcagtgccccgttctgcgatgcagtgctgcctcccgagcacgagtgccttggaacacaaatcttgcttcaggccaagttagcaggcaggcgtgcgttgtagtgagggccatcttttgttcctagagctgagggtgatggcagcattgaccagcactgggcttagggttgactgtcccaccaccagaaaagaaaattgcaggccaggacccctgatgaacaaagttgcaaaaatcctcaacaaaatactagcaaaccaattcagcagcatacaaaaggatcataccccacctgtgggatgccagggtggctcaatgtgtgcaaatcagtaagtgtagtgcattacgtctgcaaaatgaaggacaaaaccatatgattatctgtgatgcagaaaaggcattggacaaaattcagcatcctttcataacatctctcaacaaattttaggtatagaggaatgtacctcaacacaataaaggccataaatgagaaacccacagctggcaatggagaaaaggtgaaagcttttcctctgagatcagaaagaagacaaggctgcacacattcaccccttctatttagcatagcactggaagctctagccagagcagtgaggcaagaaaaagaaaaggcattcgtataggaaaggaagaagtgaaattgtttgctgatgacacaatcttatatatagaaaagcctaaagactccaccaaaaagcttttagaactaatcaacaaattcactaaatttgcaggatacaaaatcaacacccaaaatcagtagtgattctatataccagacaagaaactatttgaaaaagaaatcaaagactttaataaacttgcttaatagtaacaaagcaaacaatcttatctctgcgtcccgagctaacagaactgactggatttgtgtccagaggttttaagcttttgtttccacgttcttaaaactgggataataacacagttgatgtgttaataacagttgaagattaaatgaggctctgcccagtggctggcacaccctgagtgctcagtaaaggtcttttataattaattttttttattgttcactttcatggtcatgtttcctagaaatatgccacctatttagttatagctaaacaggatgataaaccaaacctcttaacatttgttatctcattcttatccattttacccttttaaaaatgcttttagggccaggcacagtggctcatgcctgtaatcccaacactttgggaggctgaggtgggtggatcgcctgaggtcaggatttcaagaccagcctggccaacatggcgaaactcccatctctactaaaaatacaaaaattagccagacgtggtggcaggtgcctgtaatcccagctactctggtggctgaggcatgagaattgcttgaacctgggagacggaggttgcagtgagccgagatcataccactgcactgcagtctgggtgacagggtgagactccgtctcaaaaaaaataaataaaaataaaaatgcttttgggattgaaaagcgtttattctaagttacttcaaagtcctgtataagaagggtacacaggttgaatatcccttattcaaaatgcttgggaagaagtgtccctgtggacgcgcccaagctcagtctcaagatgctgccgtgcgttccagaactcctaccttcagttattcacgataaacgtgtgacccatgagcttatctaaaatcagagtttaagacgggttgtatctttaacacatatcacagttttctctgagatttgttttgtccttatttgcttgaattttaccttctcaaccttacatggtattgtaggttttgacctccaagactgtatagagtaagttcgtcctctctgtagccttggttttttattgttgttgttaagattcgggacaacccacttacactctgtcttcccaaacaaatggagccctggccccacccatgtctctgtcccggggaatgggactatgagaccatactctgttttgctcccaacccagagaaggtatcccgaggcctccccacccatcctcctgaattgcacctgccaggactgcagggtcctgttggacgctgggaaggaggatgaggcaggagcatggctcagcccagtgagggggtctgtctgggggaaagcctttagaaatccaccgcctattcaagtcacagtgggagctggggaggaaacacggctgctgtgtgtctgagtcggggacgtgcgggcctccctcagagcgccctgacttgctgtgccctgcccgcaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggtaggtggcagcccccacgccgtccaagtgtgtgagtgagtgggcggctgtgcatgctgagtccaccccttttcactcgagtgtccaggaaaatccaggccctctctacggacttcagtgggagggatggtcagaaggtgcgatgtgtgtggtgtcccgttaggacacatctgctcagtgatacccgtgttagaattggttatgaaaaccatagaagcagggcaaacacacatgcatgcacccagacaccatgtgcacacggacacacatgcacacacgctcacatgcaaacacatgcactcacacacgcccagatactgtgtgcacacacacacatgcagacacacgcactcacacatgcccagacactgtgtgcacacacagacacacatgcacacatgcagacacacacactcacacatgcccagacaccgtgtgcacacacagacacacatgcacacacgctcacatgcagacacactctcacacactccctgacactgtgtgcacacatgctcacatgcagacacacacgtactctcacacacgcccagttaccgtgtgcacgcacagacacatgctcacacgcagacacacacatgcactctcacacacgccccaaatgccgtggctccagatctcagcatctctgggcagggctgaagtcccaggctgatgctgttcctgaatttccccgcacacagggcagcctcggggatcaggtcccagccggctgtggccctgagcacatcacttcaccttcctaaacgctgattctgcagctgcaggcgcaggataatagctccaacttcttaaggggtttcagggtgaatgtgacaatgtgagtcaacagcaggagcgccacaggtcacgcctagtctaacacacgctttggttaggagaacgtccccatcgcacaggcaccagggcagaggcacagccagggtccagggtgtttgtgaatgtctgtgttcgtggcaccgtgtgactcagtctcccttcctggacgctagcggtcacttgccatttctgagcgcacgtgaagcctctgtggtttctagaagtgtcggtgctgaacgcacgcccgtttagccttcctcacccgtcagtctcaattacaaaacagagtgcttgagaacgatggaaagctgtaattccatcccactgtataacccctcaccgcccacaagctgccttcgtggccgcggggaccccccccaccccgcttcttgttatctctctgcgcctgtttccctctatcttcagtggacgcaccgtgatttgggggttctgggaactgcttttttataggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagaggtacgtcgcgggccaagggtctgcctgggtttcctgatgtgactcagcccctccccagccccagtcagggatttgcacctagaggcgtcctcagccccaccctgtgccctccacactgagctgtgctgcctttgcacccagcttctctggacccccgtccctgtatgagcccctcccaccgtgataagcagcgtctggtccccggcgcgtgagtcttcatctctgactttgcgtgggtggcttttcctcctgaggtctgcagtaagttagaggtcattccaaataaccacaggcttcaaaatacggaaacaatcattcttttaacacaaatctccctcctgcatctcagaaaactgaagcccagaggcccagcggccttcccagagccacagcctgggccggacagagcagagctggtgcgggacctctcaccgcccaccctttaagcaaacgcttggaaaaatactttaaacattccagatacatggcataatttcaactcaggggagccattttcaaatccatccagctcatgacttctgtattactgaacctcccctccccaaaagtgccttcagggactgagtatggtgagaatcatgttcgcgcttctcacctcattacagccatgtttttgtcgctgctaaactaatgtgttttctccatgcaacttgagtagcagcacagatacgtcaacagtatcaccggggcccttcgttccatgcgtaaacccacacatgcgtaggtgaggcttcttggagctgggtttctctcttcttgaaacacaagtgcccaggaatgccactgccttcatcacaggtgttagaagtcagggcaggctaccccgcccacctttgagactcctccctgccctgaagcttttcctccagccgctgctcccacctgggctggccagaggcctccactgccatccccctggtgccgcgaagcacgtctgtctcccgggtcctctgctggcctctcgcatcccaaagccatgctctgtctctgccgtcccagtggctcccacaaggccctgaaggtcgctgacccccaggcgtgcaggaggaggcattgtatagatgggtgcacccacgtgctggctgaaggcctgcgctggaccttcgttccccgtcagtgactcaagggccttggtgtgggggtaacagcctctcagggtccctctccctctggcatcgtgttctccgctcaacaacaacaaagtccacgaatcaatgagcaaaagtgtcatcgaagcaaggattgcaggccatgtgcctgccatgctcttctggagaacaatactgacaagaatgtgcctcactgctgtgtgccaaggagggttgggttgggtagaaattctcttgctcttggaagattttttgagatggtgaataagttcattatgataatttcctaactttataatgcagtttataatctctgtttaactgaaagtatttcttttttgaaaagaacgctttaccaaaatataaagcaaatactctatgaaagaggaacatcagaatctcagattcaccccgaggtttcccttctcattgcagacttggctttacctacctaaggctgaaggacaattacatggagatattaaacagggagaaccacatcgaaaggtatgtgcagacctcaccctcagatgtgaaaggactaacgaataaagagtgttctttataaggttctgcgtttgagggaaaagacaagttctctatgttctcccacaattcgcttcctctccttcccagtgacaccccaggaatgtcaccagaatgttctggagaagtgctggacacttagagaagggcttgggtgcagccacagcgctgcttcccctggatggtttttcttggagatgtaaattggagttcagtgaacaaaagttcactgtcaaatatgttttgggttaagccacctgaagtcaggttttgctgcaggccgcgttctgacctctccaggcccctttgcctccacgaggggagtgagcagctgcccccggtgtggccatgagtcccgcagggaggaaccctggctcacgtgctgggagcacagcgtcgtgtcgaaaacagtttgcacagttacgcttttcagtcaccagtttgatgttggattgttttacttttcatatctttaaaactcttcccattttttagggactgtctctgtcccaaattgcttgtccctgagataagtgacccatcttgagatctgactcaggagagggggtggtggcttatcaacaagcacgaatgtgcggtcatggttccggcaaagacacaagatctggtggtgatggcctcaaaacacgtggattttaaaatttcattcttagggaaaataaactccccagtggaagagaaaggacaaatcccttgattcggcggggctcctgggccctccgctggcaccagctgcaccctctccacagcaccctgggcttcccgggggccgcaactcactgccgttgaggctccgggtttgcagccgtggaggtagtgaggtcgtggcctagatgagagcccccatcagggctctgccaagggacccctggctctgagctgggctggcactgcggccagagcccctccgcagcttcccactgagtccaaggccctgaggaggctgaggggcagcagcgggggctgccaaacacttccgatgctccagacgccacacaggttttctgagtcttccggtaacaggacagcaccagccaaaacgctttttcctttggttttgatctcttagggtaacgccagttcattgacaaggatccaatctctgacacaactttgagtctctgttcagcggtgtttagggagggagtcggtgcgtagggaacgcagcctgcttggcagaatctgagcctatgccctgggtaggatggggacgtagtgaggagccggtgccacagggcccagactctgccccactgggtacacctgctgcgtccttcaaatccaggcctctcagggcatccatgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctctcaaaatactaattttttatttttaaaaagtgcaacatttctggaatgctgaggaaggagtcctgggctaaacatccggcacccttgctctgtccatcttttagtgtcgagttggggccactttactgttgaaaattgcttaattccatttgtgaaagttcctctgcccatccctatcccccacccgcttttctccatgcagagctaaatgacataaaatgtttttaaataaccattttcaaggaaaaggtaatgtgggtttgcaaatgtatctataataatgttcaaagttgcaaagtgagctttgttgattggcagttgccgtaacagtgtgtctgtgagaacagcacactcggttcgtgctccggaatgctgggatgagcagtggcggggcacagtcagagccctgtggccgccatgatgttttggtgacccacacggttgggcactctcctgatcctcccactctgacctgtggctgcccctgtccctgacgattgcctctgcagtccaggtggatgcatctgtggtcccctgacctccctgcgaggagctctcccaggcactttgcatcccccaagcacaggtggacgacctcgtctccccccaccctcagcaggtcacgacacatgccacaggtcactcaacaccgcagcccctcaggctcccgcccacagtgctgaggcttgaacgtgcaggcgcccctggctgtttgccctggacaggcagggcccgtgggctccgtctgcagaggccacccctttgcatggccatcacttcctaagagctcccaccgccccctctgaggctctcactcaccttcatcaccaggttgtcctcaagtgtccccagagggcactgcccacagcccccacagtggccttgttccccgcttcctgccgtgggctttcccataggaagggcctttcacccatctgtcctttccacggacggctcaggaagcctctcccggacctcagccccatagcagcgtgcaggacattgctctatggtggagctgtctgtccgtctgcagccactggctgcctgcacgcatcccgaacgcagaaccgatgctcttctcagcaacacgctgacgtcacgccaccctccgccgagtgctcccaaatcctgtgccgttcagagccctccacgcagcgtcagagcagggcttcattaagagctgtgggatctcactcttcattgtttcctaaaaccagacactcccaggctgcatttagctctttggaaagatgcctggcaaacaaccaaacagccactccccggaaccagacaggctggagagcttcatgccagcattttcctaagatgtgccgagtttaattttaacacagtagacagagcagggccatcatcagtgccgtcgggcacccttcggatcaggaccatggtgcctcacttcctaagaccccgaaggagctgtagggggaggcagtgtgactctcggtgacgccctgtgagtcatagcggctctggggtgggcagcagcctcaggagggaggagggtgccatggctgctctggggggctgccgcctgccttcgctggttccttagacacagtcccactgtgtcacacagcatcacctctgagacacgccatcaaatgtgggatgaatccaggctccacagtgagatgtctactgatggtcataggatgaggaacaatctgtgtgtgaatgttgccaggactcccacgaagagcttttgccagccagaccgtgggatcagcaggacagggtctgagaacaggttcagatgcgcgagacttctgtgtgtcagaacccttccccccggctcggatgaggcgcagtcctgagagtctcagccactcggagttatctgggataaacgcatcctgggtgggaagttcctggtccatcccgtcacgtggttttccccgtagcagtcgaatctagctgttgagccatggctggaacatgctgcccgtgacctgcggggctgactcacgtggttttccccgtagcagtcgaatctagctgttgagccgtggctggaacatgctgcccgtgacctgcggggctgaccacggtgcccaagaaggcaagcatcagccaccccggagccgcccctgccgcgcactcaccccggagctggccctgccacacgctcacaaggggtttttgctgcatcctgaatgcccaagacctcagggcattgtgggctatgccgtggaatctttgtaaataacttctgttactatcaaaaggctgaagagccgctggatcactcgaagaatccgggttggaggcatttgtgccatgagaatatccctatccgcactgggacgcctgtggacctcctagggcctctccaaggaactgagagcttgcaggagagacggccctgccatctgaagccagccactcatcagttacttttaagagaagtttgaatatgtaattaagcaaggtgttctgtaagtagtagtcatccccggagaggttcactaattgcactggagttctccctgctgggcggggagaccctgcagccagctcacagctcgtgtttcctcctgggctcagccctgtagggggttgcggctgtcagagccggatctcactgttttggggctgagcagccccaacaggggcctcccatgatgtccgcaggacccttttttatatgtctgtacctcagtcatgtgtgctttcctgggattctccacggtggaattttgaggaaggacttcggaagtcacaggccactcggctgcatcaggccttccctttcaaaggcagatgtgaaatctctcttttgggggatcctgcggatgcttactgcacccaaggtattatgtacgcagtacacagaagaccgactcgaaagaagaaaaggagagtacataagcatattcatctatgaaaaagaaaagcaagcagaaaagatgaaagagaaggaaagtcctaacagtgcaccctcctggagctcctccaggagctgcttccttgatgccctttttccagccatttcggggacatttgctgtcacgcctggctttccatgtccttgagctggtctgtgagacacagtgaaagaccccccaccatgggctcaaactgtggttctatagccctttctcttctccaaatggcagtaagcccttcttggtcccagaggggacagccaccaaccacggctgcacctgcgacacaacccagctgtcttggggacaggatcctgtgtgttcggttatgtcacctgtgtgtgcacggtcttcagttgctcattgtagattaacttttgctctgtcctctgggtttttttattccaaggctgttcctcaccaagtcttcaggctgaaggtgtcctgtgtcttacagtggaattcacaagctgagacagtgggaaagttaagccattcacatgctcttggcatgagttgtgagccatgaaacatgaattttctagtaaaaaatgtgctgttgttcaagaatgcatcattatgtcatttggaccacagttctcattctgaactgtatctgatgaaacaacagcgttggctggaaaccatgggagtcgggaaacggctctgacatcgattgggtagtttaacccccgggccctgcttttctatgctaagcaactgagactctgtggtcacacctctgcagttctgcagagatcctccagggtccaactcccagcctcagcctgctcactcccgtgccctccagcctcagcctccccactctcccgtgccctccagcctcagcctccccactctcccatcccccccagcctcagcctccccactctcccgtgccgtccagcctcagcctccccactctcccgtgccctccagcctcagcctccccactctcccgtgccctccagcctcagcctccccactctcccgtgccctccagcctcagcctccccactctcccgtgccctccagactcagcctccccactctcccgtgccttccagcctcagcctccccattctctcatcccccctgcctcagcctccttactctcctgtcccctccagcctcagcctccccattctctcatccccccccagcctcagcctccctactctcctgtcccctccagcctcagcctccccactttctcatccccccccagcctcagcctccctactctcctgtcccctccagcctcagcctccgtcctcccccatgccctccagcctttgctcggcactggtttgctgcatgtattggcaacacctgtgtcaccaggtgccatcctctctggctgcaggttggcagccacctcagccacatgagcgtcaagtgtagccatgttcccacagcttccctgttggtgtctcaggagttagtgcttcctggcatccaggaaggaaggcaaggcggacccctgttcctactcctgagtcctcgtccaagctccaggccttggatccgggtcgtcagcccgagagcgtcccctccccatgtccctcccaccaccaccctggggaccactgcctgcccactctggggccctctggatttggtccccagtagacttcccgagggccctcagtgtctgggggtctcagggctctgccccgccaggagctgggcatggagcttcctacgcgtgccgctcaggctgctgtggtgtttctcccaccctgccgtcaccgcgccgtagcacggcgtttccctgcacccaggcacaaaccagccgcctggcagagtgccacgtggcttcgcggaccagggatgcttcaggtgcagagggagctctgtgtgtcgggagcacctgcgcccaggcacaaaccagccgcctggcagagtgccacgtggcttcgcggaccacggatgcttcaggtgcagagggggctctgtgtgtcgggagcacctgcgcccaggcacaaaccagccgcctggcagagtgccacgtggcttcgcggaccagggatgcttcaggtgtagagggggctctgtgtgtcgggagcacctgcgcccaggcacaaaccagccgcctggcagagtgccacgtggcttcgccgtccagggatgcttcaggtgcagagggggctctgtgtgtcgggagcacctgcgcccaggcacaaaccagccgcctggcagagtgccacgtggcttggtggaccagggatacttcaggtgcagagggggctctgtgtgtcgggagcacctgcgcccaggcacaaactagccacctggcagagtgccacgtggcttcgccgtccagggatgcttcaggtgcagagggggctctgtgtgtcaggagcaggtgacatcacagcagaactgtcgtggcctttgctgtatgctgcagtgcctggaagagaaactcgctttatctgaggcctgagaagcccacgttcacagcacaagtatgtccacagcgatcacagtgttactggacgtgtgggaaaaaatgacgcaaacgtttcccctgactcttccaagttcagaggtggcccggctgccttgctctgcatgaggacagatgactctccgaaggggatttgtgttcaccttccagcatttcagaaaccaggaccccctttgggtcaccccaacgcccgtcccgagggcattttgtcccctttcgtgtctttcccagagaaaaaacagagtcccggagccaagttcttttcctcgttcctgcctctcctgtggaatttctagggtgtaggaataaaacgaggctttggaggttatctgtgggtttattttttcctgactgtagcgtgttaactggtccattaaaatctttaaaaagctttccacactgctatccctgttttttgttttttaataatggcataattttaaaaaataatctagtcttccccatattgtgattaaactcctcatttttctcattttgtaggagaaatttatctgttttgcaaaggagcagattcttcgatattcccccgagtgatagaaggcaaagttgaccagatccgagccagagtggagcgtaacgcagtggtgagagccgggctggggagggcctcgtggcggtcagctcccctgctgtcaggaaggaattccatgttccacaagttcctggctgggaatggcgtattgtattccttggggaatgtttagaaatcagctgggccagaggcagacagacaggcagcctcagccggcaccgaccccagggggcctccgatacccagccaggcacaggctgtccagccaggcacaggccatctcctccccagccttgcacagggttttattttcgggtgggtgccaggttggttgattgatgttttggggagtcagaattagcacgtttgtggttattgtattggagcaaaaagtctttgtgttgacgtttctagtgatttgcttcaaaacaaatcagcactttcgttttctgttgtgacatcacctgtttgggtttctttccccatctgggtcttaagcttgtatgataaggtttctttccaccacttgttgtatagcaccgcccagcagcccgcacacctgagcctcccactccgtgggtccggctttctgtctttggggctgctgcggtagggggccggcctgagtgtctctcacagcagggcctcccctccccgtcagacgcgctaaagccgggcaacacgtggctggggtggacacgctccctcctgtcagacaccttaactccgggtgatgcgtggctgggtggacatgctccctcctgtgagaggtcctaacgccgagcgacgcatggttgggtggacgtgctctctcccgtcagatgtcctaacgccgagtgacgcacggctgagtgcacatgctccctcctgtgagatgccctaaagctacactgtgcgtggctggggtggacgcactccctcctgtcagacgtcctaaagctgggtgacgcatggccgggtgggcgcgttccctcccatcagatgccctaacgttgggtgatgcgtggctgggtggacgcgctccctctgctccccacgtggctgctttgtcccacggtgtctgcacccttctcccgacaccaccctggggtcttctccctcactccagcccagggcagcacctcctctcacaccgaccttatcatcttttcatgaaaaagaaacagtaactgacaggctctcctcccagaggtccaaaatgacgctggccagagtggctacgcactggaaaacaagacttccaaggctggctctgcaccaaggaaggctgaaccgagagaaccttggactagaggtcgtggtactcagcgctcccttcactgaccatttaaatgtaaagcaatgtttgtcctcgctgtcagtcgcaacacttgattactgtagatgtcagagcattaagaattcctgccgatggacaggagccctttcgctcgcgagcccgtgcgtgcagcagccagagcctgtgaacttcgtggaatgctgtcgacgtgcggatcatcatctttacgttgctattaaaacagctcctggcactacaaagtagctgcgttggagccaacaggaatccataaatcagcagcaggttaaagattgttgaacttctctgtgagggatctggaaaatacatcactgacttccaccagccacagagctgcagggtgggagccgagcgggttcctctgagcagcacaagcgtcctgcgcttcgacacacaatgagcctcagtacaggggcgtgtgggggctcctgagggggcagctccatctgcagctcgctttccaatagcgcgaggctgtgctttgctgtgacgtggtcgccgtgccatgctgagcacacgatggctacaggtcacaggtgactggtcctccatggagggtcttcatggcctgagtaccaaatatcttccacctgctggatccccactgctgctgcccaggagagtaggcgcatggattatgtgaattgtgatgattgtaaagtccacttgctgcttgtttcagaaagtcttcttgagatgtaattgccatacattgatctatacatatttaaaatgcgagagcagcaagggcattgacacacgaacacacaggtggaggctttgcctgctgggaaggggacgcatccctcaccctagagactgtctcgcgccctcatactcccatccctgccaactcccactcgctggagaccaccgctccactcgccgtcactgcagattcgtgcccaccttctggagcttcctatcagcagaatcacaaaaggcggctgttgtatccggcgtctttcactcccataactgctgagactcggccgtgtgggcccgttcatttctgtcgtgaggaacagcagcactcgttcagttgccgagcactagcggtactagttcagcggccgctagtccaagtacctctagcggtactagtccaagtgccgggcactagcagtactaaccagtccagttgccgggtgttagtggtactaaccagtccagttgccgggtgttagtggtactaaccagtccagttgccgggcactaacagtactaatcagtccagttgccgactgctagcggtactagtccagttactgggcactagccatactaaccagtccagttgccgggcactagcagtactagtccaagtgccaggtatcagtggtactaatcagtccagttgccagccgctagcagtactagtccagttaccgggcactagccatactaaccagtccagttactgggcactggtggtacagaccagtccagttgccagccactagcggtactagtactagtccaagtgccgggcagtagcagtactaaccagtccagttgccaggcgctagcagtactaaccagtccagtttccaggcactagtgatactaaccagtccagttgccgggcactagcagtactaaccaatccagttgccagcactagcggtactattcagtccagttgccaggcactagtggttctaaccagtccagttgccggcactatcggtactaaccagtccagttgccagcactagcggtactattcagtccagttgccagcactagcggtactattcagtccagttgccaggcactagtggttctaaccagtccagttgccagcactagcggtactattcagtccagttgccaggcactagtggttctaaccagtccagttgccggcactagcggtactaaccagtccagttgctggcactagcggtactaaccagtccagttgccaggcactagtggttctaaccagtccagttaccaggcactagcggtactaaccagtccagttgccagcactagcggtactattcagtccagttaccaggcactagcggtactaaccagtccagttgctggcactagcggtactaaccagtccagttaccaggcactagcggtactaaccagtccagttgccggcactagcggtactaaccagtccagtttccaggcactagtgatactaaccagtccagttgccggcactagcagtactaaccagtccagttgccggcactagcagcactcgttcatttgccgggcactcgcagtgctagttctttctacggatggaccagtttcttgattcttccgcctgttggcagacattgggttgtttccagttggggctgttttggaagcagctgctgcgggccgcctgctgtgcgtgtctggggctgagccgatgtgtccttttctcctggggaccctcctgtcagagcgtcttcatttctctttccacagcttcccttttctggctgcttttgaggtgtttcgtgatgggatgccttggtggagtgatgctgtgtttctttgctcagccgtgttgagcatctcggatctgcggcgtttcatcaagtttaacatttttcagcaattattctacagatatttttcttccttgctccctttcagcagttccaggacccatgtactcaactgccggatgttgtctcaccgcttacaaaggcttttccctttaaggttttccacgtttctttagagacggtttctgttgccatgtcacgagtttttcccgtgcagcgtctaacctgtcagcaccccacgcaggacacccctctcctcaaacatcggagttttcatgtctagaaattccgccagcgtggttttgtatcctcatgcccctacttaacatggggcgtgtgtgataacgattgcggtgactgtttaaatcctcctcgctaacggatgggacgtgtgtgataacggtggcagtgactgtttaaatcctcctcgctaactgcacccctgctgccagctctggaccagccacagtgttgcacagtcccctcgtttggggcagggacggtgcccctgcgtgatggtggcctgtggccggatgcctgcctgtgggctttgttggatgctgggtatcgtggtcctcctggagatcttaaatcttgttctggggtgtggctgagttcctgggaacagtctgttcctttcaggccatgccttcgtgatgtccagcagacccacagcagtgcctgccccgggtggtgctccccagactgccaggccctgagcgctgtgcctggtgagtggccatgcctcctggcagcaggctgtcccaccctcctcctaatggcttgttgctggcctccaggagcttcctcacagttgcaggtgcttgaggggccgtccacagcctctggcatccactccatcctaggaactctggtgcttgttcccttgacacccaggtctgccccataactcagggaattcactggctccggctacgttcccctgcccgagcctcggcctggaagctctccgggtagtgagctgggcacttgcagggccccctcggttggcagcattttattttgaaataattacagatttaggagaagttaaaataagtagaaagacagtccagaggggcctgtgtgtccttcgagtccagttaatttctcctttcgctggctgtgcttgctgtcatatcgaagaaactgctatgaaatccaagatgatgaagatttgccaccactgtgtttttttctataagttttctagttttagctcttaaatgtaggagtgtaatccatgtttggctaatttttgcatctttcataaagtgagggtcctactttatttccctgcatgcagttatccagttttcccagcaccatttggtgaagactctcctctcccactgagtgatactgacactcttgctgaaaagcatttgattacggtacctggaggtttatttctgggctctctgttccatcccattttctctatgtctgtctttatcccagttcccgctgttttgattactgtcagtttctagcaggctttgaaaccaggatatgtgagtctttcaactttgttcttctgttataaaatggtttggctattctgaacctcttgagatttaataggaattttaggatgggctttttcatttgtgcagaaaatgccactgggggccaggtacggtggctcatacttgtaattccagcactttgggaggctgaggcataaggatcacttgaggccagaagtttgagaccagcctgggaaacatagcaagaccctgcctctacaaaacatacaaaaggaaaatcagccaggggtggaggcacacatctgtggtcctagctactaggcaggatgagatggaagggtcgcttgagcacagaagtttaaagcagtagtgagccgtgatggcaccactgcatgtttccacgggcaactgagtaagaccctgtctcaaaaaaagaaacggaggaagggcgggagggaagagccattgggatgttgataggatttcatttaatcagtagatcactttgggtagtgttgtcatcttaacaatccatgaacatgggatatctttccatttatttaggtattttataatttctttcagcaaactttggtatttttcagccttgagtcttttacctccttggttaaatttattcataagtattttacttttgttgatgctactgaagtggaatttttttttaatttccttttcatattgttcattggtagtgtatagaaatgccactagttttcgtgtgttgactttgtaccctgtgtctttgctgaattcagttagtggggagcacattcttcatggtcttctggatataggatcatgtcatctgcaaataggccttagaaaggcatcctttctaatgtggaaactttctttttctctttatagcctaatcctctcacttagagcatctaatactctgttgaatagaagtggcaaaagcaggcatccctgtcttgttcctgatcctacggaaaagctttcagtccttcaccatggagggtgatgttagctgtaggtttttcttttcttttttttgagacagagttttgctcttgtcgcccaggctggagtgcaatggcacgatctcggctcactgcaacctctgcctcctgggttcaagccattctcttgcctcagcctcccgagtaactgggattataggcatgcaccaccacgcctggctaatttttgtatttttagtagagatggggtttcaccacgttggccagtctggtcttgaattcctgacctcaggtgatctgcccacctcagcctcccaaagtgctgggattacaggcgtgagccatcatgccttgctggttttttcacttaagtggtttttaccacgttgaggaggtttcttctctccccagtttattaagtggttttatcaccaaaaggtgctggttttttttcagatgccttttctgcatcagttgagatgatcatgtgggatttatgtcatgtattgcattgactttcatatgttgactcacttttgcattcctggaataaaccccacttggtcgtggtgtatgatcctctatgtgccattggattcagtttgctagtattttgttgagcatatttgcatctatatttctaagggatattgttctacagttttcttgtagggtatttgtctggctttgttttatgtgctgtgtccagggttttcgtagtacttagcaggaggaatagagaaaagtatttctgttctgtgttaccacaagagaaagtccctgattgacttttaaaagcagcgacatatttatttccaaaagcttctgcttatcactcacagcaacctaagttctgggaccattttgggttattatcctgtaaaaccattttcttgttatgtaatttttctggtttcagactgaagctatatatcttgtatgttttattgcctcttaggaaaagtcagagaattcattctgcaattcgcatttatgtctccaatctgtaacttgatcaacaggtgcacaaaagatctaatttcaaccacttatttattcagcaaacgttgttgagttttggctgtgtgccagggattcagtggtgaagtcagacacagtgcccacagccagagaacccagtgcctaacaatagaggcaaacccgtgagcagaaagctgcaaggtcgtgtgctcagcaggaggtgaggctggggtggctgagcagcgtctgttcagtgctactttcctctgagacgggtccactggcttctcacttattcttgaccaggagacaatatctggaggatgggaaggaaggagttccagaatgttcctggagaacaggactcaggcacacatagaccctgtcttgtgttctgacttcttcaactccccctttcccaacttctggcttttgagagctcaagggccatgacagccgttgacccagtggcaattctgtccacaccagttaagaggtcggaactagtgataaatatgagccttccctgagagttaggagacgcttcatctcatagaacggaaaacattgtttcaactcttacaaaccagcattctgccggattttaaaatggttatttgggaggattatggttcttttactattatcagtagggctggggctgaaggagcagggaaaacggaaggggaacaccctagatgatcaggtgtgaacctctgtgacggtcgcgctcagcagccttgactgatggaatgaagaggttcatctgtaaaccgccccctgtgtggctgcttcagcctctgcccccattccttgtgtcttgctggtggcggctgcattctctctgtatggtaacatccagaatgatgatcacagtaaggaatttgtgattcttgatttcttttgttcctgtgcaaccaatgattttgataaataacctggcaggtttccttcattgtgaaagaacaacctaccttacaaacttcccacataaaacatgtttactttagaaatatcacttgatattacccataaaattacaaatgattatccttaaaaaaaaaaggttaaatttaactctgcatttgtcaaaataaaggaacaaattttatcttttgatagatgactctgatttctgttacttatttccaggctttctagtctgaaaatgctgtaatccataatgattcttggtatttaatgtagacttaaataattcacttgttgatgacttactcctttcaagatttggttggattataatctttctttctttgtttacttagtactgtaagttttgaaagggttacaattcttgggttagttagtctaatgagagaagggatactgggaaggccgtggagcgtaatatttcagcaagtgacaccttgaattcgtgctaaacgctgcattgtgttctgcaggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggtaaagtaaacgcatgcatcccgtcctgagagacaaactgggatgcaggccgacggcccagggcgtgtgagggcgagtggacgggagggaggccatccgcacagccgacggggcgtgtttgctgctcagggagaggctaggtgtcttgctacaccctggagtcatgtcaggaaggtcatgcctgggggatattttgttgtccatgaagaagatgcctgaaagcacactttcccaggaagtagtgaaaatagctttgtcatatcatattatgaacaggcaagatagaagggctcttacaaattctttcttctttttttttaagggatggcatcttggtgtgttgcccaggctggagtgcagtggcaccatcacaactcactgcagtctaaaactcctaggctcaagctgtcctcccttctcagcctcctgagtagctagaacttcaagcacataccaccatgcctggctaattttttatattttttgtagagataggatctcactatgttgcccaggctagtctcaaattcctggcctcaagcaatcctcccacctcagcctctgaaagtgctggaattgcaggcatgagcagtcatgcctgactgtaattactctttagaatggaatcaacaactaactctgttcctaaacttgttgctagttctttccaaatactggtattacttcttagatcattacatactcaatgtgtttatcattacttgaaaaaacttaatgaagtagaaaattacaaaaactaataatcatcataactggcaaaattaccaattacagattttcaggtacctctaaggcaagagctgccagtgtgccccagctccacaatggggactgaaagttgtttgaggctgaggccactaagaaacagtcgtctggtccacatggtgccttccgagctgagtgaaaggcatggatttcagtggtttgtaggaatggaagaaaaaaaatgccccaattgatgagaatgaagcagaaacttcagaaagttcactgggagtttatctcctagaagaggttaaaggcatcaagtttgaaagtctttaagatccatttcggtccaaaactgaaatccttatcactaaccctgcattttctgagcgtgttgaacaaatgttccttgagttctcgatctgaatggagtattaggcgaagtgggaagttttggtttggtggttttgtgttttgttttgaagtcactctcccctgttcagtccagagtaagtgcacagagcaccgtgtaaagaacgcgacttgcacgtgggaaggcttcagagcgcagggccacggccgccgaaaggctttgctgctgggggctgcgtccttgctctagtggccagtcactcacctgctgtctgtccaggagaagaggggtgtccgtaggatggtgtttgcctggggagcagctgggtcgatctttagaggccttggtggaggagcgtggggatgcctccggcagagcagatgggacagagcccctggggcggggggcaggttgacttgactggaatgggaatgtagaagagtggagagttaatgcctggttggcggggggggatctcagtggctttttcgtgatgatacttgcttataaattatttccttataatctccagtcagcaagtgcgaaacatctctgagcctcagcttccttttgaatcgaattgtagggccaggcccggtggagcacgcttgtaaacagggccaggcccggtggagcacgcttgtaatcctcgcaatttgggaggctgatgcaggaggattgattaaggccaggagtttgagcccagcctgggcaatatagtgagatcccatctcttgaatttttttttaattagtcaagcatggtagcaggcacctgttgtcctagctacttgggaggctgaggagggaggatcgcttgagcccaggagttggaggctgcggtgagctgagatcataccactgtaccctagcctgggcaacataaggcgttctctcgttctcttgctcgctctctttctctctctctatatatatatatatgcacacacacatatgtacatacacacacacacacatatatatatacacatacatacacacacataaaattacaggcttttttttcatctatagaatactatgattgtctgatcttgagacttttagctaggaagttcttcccaaaacctaaccagatccttccagttagaatttaaatccattcctttcatactttctagaagcatggcacgttacttcacacgaaagtagtctgaaacttagaaaaaatggaggccccaaagtgaggcagacatggtttgaccccagatctcccaaggagagggcagtggtctgactgctgtcggaagagccgcttacccccgacaccttctgcagcgtctgcaggctttgggttttccatatgtaaataggtgtggtgctagcgtccttactcgtgacatcatggtaagcatgaaagattgcacataggaagtgtcacacaggcctggcatgtggcaagcccatggcacctgttggccatagaatcactagtgttattctcagtattttatattatttagaggtacctggaccccaagtgggttctaagtgacaaacttagaacagtttatacaaaacaaaagacaatcaatattcctgaccaccttgagtccagatcccatctttccatggttgagacatttttggtggtggttataatttcctgaaaccctccccaggtagtgagtcccacctacacacaaaaccgccaggcttgtcagacgtcagtgacacaagacagccctttacttctcacatgtttgatccatgtttatctctctgctgttaggaagtgtttcgctgtgaaacactagttcagaccttcagaagctgcttcagtacttcgtggtgagatcatgagccacagtgtggagtgttttgattttgaggggctacgatattttgacagctttgcaagtttctgcagttccttatttggattcctgggtcagcactgacttttctctatgctgtgtttggttttgcctccctcaggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccgggtaggcagcgcgtccccgcccccacccccacactcccgcaaaaggggcttcagacccagtggccttcacctgcaagtcggggagccgcattgtctctactgggaattcggttctcccctggggcattaatgccagcttcttaggggtcaggtgaacactgggaacaaaacgggctgttttttccagcaattgtgatgtgtctttttcacatatgtgtgtgtatgtgtgtatgttcagtttcacactgccggctaacagatgcaaaaagacatgatggataaaatattttgagtgggataattctcatctgtttctgagacttaggggctctgcttcaggcaccttcaagcatctgctggaggaagtggagatattaataatgcatggttgttcgtctaagacgaagcagtacatgcccaagagttgtttttttcccaagaatattcagtagtttattcagatacattttatcgatgctgtccttactggtgttagatgcattatctgagattacatgttatttgaatcatttcagtttcattcatgtacataaagcgaaagcagctctctaatttacacaaatgttaagttattcataaatagcacagataattccctctacctgatctgcaatctgcagaactccttttagggattggagggttttttttgttgttttttgttttttgtttttgagatggagcctcaatctgtcgcccaggctggagtgcagtgatcttggctcactgtgacctccgcctcccaggttcaaacaattctcctgcctcagcttcccaagtagctgggattaaaagcgctcaccttttaatagagacagggtttcaccatgttggccaggctggttttgaactcctgacctcaggtgatccacccgccttggcctcccaaagtgctgggattacaggtgtgagccaccgcatccagccttcttgtcattttgaaacccagcaaagaggagattatgaccatgttctttccaacttaggtcatccaggcagaaacccaaggacttagctgtaaagactgtgaccaagaaggttgagagtaaagaccaaccaagatcttagaccacaagatgaacgccttcctgttgtttcaaaagtacagggacttaacgagtccacaaagagagtctgcacttgctttacctaaaataggaatgtttcataaaatacactcttaaatgtcgacaaaaggtgttatgttcaatactataaaaattgtattggtaaaacaagaaacactagtttcttaatcccatggatttgtagcatctgtcgatatccaaaaacaatacagtcttctaaaatctatagatttagtgattgagcaatctttctgactcacgtactctaacagactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcaggtgctgcccgcccgtcctcgatagctggtggtcagggcgtccaaaacactgaaaaccttccgttaggtctcaccgcctcagattgttaaacaatctagcagggtaccacctgttaaaaatagaagcaaccgtgatagagatttaaaacgcagatcttgttttgcttgtcgggccagcttctgtgattagtgggtgatgaccagtcagatgtatgacccttccagatgcagtggccaggacagctgccctggctgacttctgttaaaaaaaaaaaaaaaagctatctcaatcactcctgagaatctacactaaaggtgtaagggaagggagctgacattactgagcacctagtgtgtgcctcctacagatacgaatgcatttagtctcaaaataaccctctcagacaaatgagggcaccagctttacaaatgggaataatttgccgaaaaggctgcagatgggaaatgccacgaggattcaacttgtcttgtccatcaaactccaaacgtctcacgcggccatgttcttgtgggaaacgcacacctgaagttttttctttaaatagttttgaaagcactatggaatgtattgtaaacatggatgtctttctggtatcaggaagcctagaaaagttctgactttgttataccacattttagatatgataggccaatttctcttgaactgttcatgaataaatccatcattggtcagagcaaaccagtggttaaggtaaaatgcgtctcacacaaactctggaaaccaaggaggtgaaaagttgagcctttgtgcatgtgggtgcactaatctgtcaatttcactaaaaacacagaaccagggtcctcagaatgacgagcctagagcattcacagaccttccatgtgaggaagacggtttgatgtcctcctctccctcacatgcgtaactgcacataaaccttacagaattacttcccaaatggaacagcaactaaggatttgccattcgctcttcatgtattccatagtacttttttaagttctcaactggcttttgaaacatttcatacaaattaacttgtgtttcagtttcctatcttgaaacaagaaggcacccacgtttccccccatctcttcattcttacagcttgaactgttacatttaggcacatagatgggggggaaaagattataaagaaattgactaaaaacttggaaattatttttacataaaattgtcatatttgattttgcacgttacaaatttgaaaattaaaatagcattaggaatagtttatgtttagaaatagatgctttataccaaatagcttgaagtaccttggaatagtgatcttacagaatgcagggttcacatttgcccctgtatatttaaatatattttcccaggatttacacacttttccatatatttaagtagaggaatataacaataactacaagctacttcatatatctcacatctctactgccaaagtttgtctaccagccttttccagctcacgtcattttaatcatacctcatttcttttactttattttgttttgctttcaatatgaaaaaggttttatcctatatggagaaaacagacagaatgtcgtaaattacctctaagtagttaatttttttatttgcctaggctaacttttcatctttgttatttctgcctagtgaatgaataacctgttcagaagtgaaacagagaagataaattccgcatttctttcttttgcagattgttaaattaatcaaattttcaaaagagcacccaatcacgttagcaattggcgatggtgcaaatgatgtcagcatgattctggaagcgcacgtgggcataggtgagcttcgtccttgctgctggcacatcctggtggccaggtcaccccttcgctagacaaaggcccatggcagcacgcaggtgcattcaggacacccccgtcaccaccctcgtgtgtgaccgggaaggctcatgatgatggtttcatccgttcttctccccgtccctgccctgtgtgtggtgtgcagaaagcatttcttcagctccttcacctccgtcttctaggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataaggtaggagggtcgccgctccccctcacggtgttagcaacaggtcacgcacagggtggcacgacccttgtctgagccacttgatgccacaagaggtcattgatctccgaggagcagcaactgtcagaaaggaaggggtgaatctgattgcagtcatctcttgcttagctgtgactttgctttttacagtttccattacctacagtcaacccatgcccaaaaatatcaaacgcaaaattgcagaaataaacagttcctcaggtttaaattgcatgccattccgagcagcgtgatgaagtctcacgccgtcctgctgtctccttcctgggatgtggcttgtccctttgtccggtgtgccgatgctgtgtgtacactacctgcccctcagtcactctgtagctgtcttggtgatgaggttgacagatcacaagaagaagggtgaatatgacacaataatatattttaagaggaggagggagagaccaaattcatgtaactttgattacggtatattattatagttattctatgttttgttgttactctttcactgcacctactttataaattaaactttatcatgggtgtgtatgtatacgaacacacatacccatctagagcatagacagggttcaggaccatccgcagactctgcatccccccagggtctgggaatgtacccctgaggatgaggagggcctgccgtgccgcgggaggagacccccagcccttttctccccccacagaattgagtgtggaaccagtgagaacctttcaggtggaaatgtttgaggaaggattccttattcactgtgcagttcgattctttcccgtttatactgatacctgcattgccttcttgtttctcttggagctgacaaatttcctctatacgttgtctgtcctgagtggccaaaacgtggtcacatgtgcatttcagttgcccctgaaataagagaaagctttctagaacccattagtgctgttctgccgcacgctgggtgcacgtggatccctcctcccatgtggggtgggccacgtcggtaggtggcggctgcctccctctgtcccgtcaccgaactaacagttatgccttgcctttcagaacgtctgcttcatcttccctcagtttttataccagttcttctgtgggttttcacaacaggtcagtcctagggtcttcagggacaggctgtctgagccttcttttccttcccgcagtgggtggctgctgtggggaggggagacttgggaatgagcagcactccccggcaccacgagggagccagggtgcccagcagcaggcgggggtgaagggtcgggcctggggaggggggccacggagctgaggagttgccgtcctggaggccccttgttccatgtcttctgaaactgccgtggccctgagatgcgggccagtgatgatgtggtctcctcagggcccagcagtgctgggctgggcatcctgatgccactgcaagaattaactccaactcgaggtccttgtggacatgggccaccccggtgcctggcacgttaacacatgcaacgtgcccataggggaagaagacagttcccatccgggaggggtgaaggactccccgggcatctgccctagatggacacctccttctgtcacatgtgtgctcagtggttggcgggccagctgccttcatgggaagtgactgcgaccagagtcactgaagcttgaagatggcaatcagaattgcaaatgttttctgtgacttttttccttttttttttttttcttgaagtttgtgctgatagaatgggatgagtcagtgttaggctttttgccagctgtgactttcatcctgaaatcacagttgatatcacagaccctagtttatattgttaagctttgaaaagcgctctggtctttctatgcatttcagaaagaaaatatatttaatcaaaagatccaaaaagtttgtaacaatgcactgaggtgccacttcttgtgactttcctcttacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttgagggccagaagcattcggcatctgctgatattcttgcttgatcaggagcttgtttaaactggaagcaacatagctcaaatggagattcttcaagtcttgctggatggtttatgctgcatttggaacatctgtgtggagccagtttgcactttcctgtgctttctgacagtcctgagggagctggggtacaagcgtcttcctcgttgtgaccctagggaatctgtggcctaagttatcctttaaaaccatgtgtgttccattcagtgagaaaaaacaaaaattaacagctctggtttcagggtgtcttttctccccgttattttttaaaaataatatggaagagatatttttctgctatttcagaaatgccccccaaggtctctggcagattcaatatgttactgttttccatggtcttttaaattgtattagtccattttcatcctgctgtgaagacatacctgagactgggtaatttatgaaggaaggaggtttaatggactcacagttccacatggctggggaggcctcacaatcatggcggaaggcatgaggagcaaaggcacgtcttacatggtggcagacaggagagcgtgtgcaggagaactttcctttataaaaccatcagatatcgtgagacttagtcactattacgagaacaacatgggaaaaaaccacccccatgactcaatcactgcccaccaggtccctcccatgatgcgtggggatcataggtgctacaattcaagacgagatttgggtgaggacacagccaaaccctatcataaattaaaattttatttttcagataattttacatccatatgcagttgtaagaaataatagattctgtgggccctgatcccatgtcccttagtggtgacacgcaagaaactgcagtccagcatcacatccagtgtactgatgttggtgccgttcacccgttcccttattcagatcacccagctttccctgcacttacgtacatgtgtgtacatgacacgtgtatgtgtgtgttcaattctgtgcagtcttctcacatgcgtgtttcctgcatccaccaccatagccaagaccactcacttccctgcctgggattctgcaggaatccgtgcatcggcctcactgccctcatcagaatatttagccattctgtgggatcttgacggcttggatccaaaagtaatcactgtaggtgattaaggacgatgataaaaaggcaaacttctgagttggttgtacatctttaataaatctaaagaaaatgggaataaatctaagaaaatgggagaagatatactgttctagacatgtgtctgaaaggaatcctgcaaattctgtcttattgaacaggcatctttaataaatctaaagaaaatgggaataaatctaagaaaatgggagaagatatactgttctagacatgtgtctgaaaggaatcctgcaaattctgtcttattgaacaggcataaggtgtcacgtcaggcgtaaggtgtcacagcaggcgtaaggcgtcacgtcaggcgtaaggtgtcacagcaggcgtaaggcatcacgtcaggcgtaaggcgtcacgtcaggcgtaaggtgtcacaagctcggtgaacgtcaggggtgtgccttgtgttctctgttcgttgctttcagaagcagcagcatgtggcagcatctctgtgcctatgacgatattgcagtgaatatgagagagaaaatatctgagcaaaagttagccaaggacatgagtgggtagtgaaatgctggttgtgatgaacatgccacatttgtggccagagcacaaacttgatgtttactggccgtgcacatcttatcccatgaagacaacgtccagggatggccaccccagagcctgggggaggtgccgggccctgattctcgaggacacacgctgtgcacctttctcctcaccagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcaggtcagtacagagctcgattgcgctgacttagctgcttaggaataaagcctcccaagcccatatgatgattttgccaaagcagaattcagtgcagcccatgcagcttcccagcggggtccatcaccacctgcgcagtaattcagtgcaggccacgcagcttcccagcggggtccatcaccacatgtgccgtaattcagtgcagcccgtgcagcttcccagcagggtccatcaccacctgcgcagtaattcagtgcagcccatgcagtttcccagcggggtccatcaccacgtgcacagtaattcagtgcagcccatgcagcttcccagcggggtccatcaccacctgcgcagtaattcagtgcaggccacgcagcttcccagcgggatccatcaccacgtgcacagtaattgagtgcagcccatgcagcttcccagcggggtccatcaccacctgtgcagtagttcagtgcggcccatgcagcttcccagcagggtccatcaccacctgcacagtaattcagcgtagcacatgcagtttcccagcggggtccatcaccacctgcacagtaattcagtgcagcccatgcagcttcccagcggggtccatcaccacctgcacagtaattcagtgcagcccatgcagcttcccagcggggtccatcaccacctgcgcagtaattcagtgcaaaccatgcagcttcccagcggggtccatcaccacctgcgcagtaattcagtgcagcccatgcagcttcccagcggggtccatcaccacctgcgcagtaattcagtgcggcccatgcagcttcccagcggggtccatcaccacctgcgcagtaattcagtgcaggccctgcagcttcccagcggggtccatcaccacctgcgcagtaattcagtgcagcccatgcagcttcccagcggggtccatcaccacgtgcgcaataattcagcatagcacgtgcagcttcccagcgggatccatcaccacatgggcagtaattcagtgcggcccatgcagcttctcagcggggtccatcaccacctgcacagtaattcagtgcagcccatgcagcttcccagcgggatccatcaccacctgcgcagtaattcagtgcaggcctgcgcagcttcccagcggggtccatcaccacctgcgcagtaattcagtgcagcccatgcagcttctcagcagggtccatcaccacctgcacagtaattcagtgcaggccatgcagcttctcagcggggtccatcaccacctgcgcagtaattcagtgcggcccatgcagcttcccagcggggtccatcaccacctgcgcagtaattcagtgcagcacgtgcagcttcccagcggggtccatcaccacctgcgcagtaattcagtgcggcccatgcagcttcccagcggggtccatcaccacgtgcacagtaattcagtgcagcacgtgcagcttctcagcagggtccatcaccacctgcacagtaattcagtgcaggccatgcagcttctcagcggggtccatcaccacctgcgcagtaattcagtgcagcacgtgcagcttcccagcggggtccatcaccacctgcgcagtaattcagtgcagcacgtgcagcttcccagcggggtccatcaccacatgggcagtaattcagtgcggcccatgcagcttcccagcggggtccatcaccacctgcgcagtaattcagtgcggcccatgcagcttcccagcggggtccatcaccacatgggcagtaattcagtgcaggccatgcagcttcccagcggggatcatcaccacgtgcgccataattcagcgtagcgcgtgcagcttcccagcgggatccatcaccacatgggcagtaattcagtgcagcccatgcagcttcccagcggggtccatcaccacatgcacagtaattcagtgcagcccgtgcagcttcccagcggggtccatcaccacctgcgcagtaattcagtgcggcccatgcagcttcccagcggggtccatcaccacctgcacagtaattcagtgcggcccatacagcttcccagcggggtccatcaccacatgggcagtaattcagtgcggcccatgcagcttcccagcggggtccatcaccacctgcgcagtaattcagtgcagcacgtgcagcttcccagcggggtccatcaccacctgcacagtaattcagtgcggcccatgcagcttctcagcggggtccatcaccacctgcgcagtaattcagtgcagcccatgcagcttcccagcgggatccatcaccacctgcgcagtaattcagtgcaggcctgcgcagcttcccagcggggtccatcaccacctgcgcagtaattcagtgcggcccatgcagcttctcagcagggtccatcaccacctgcacagtaattcagtgcagcccgcgcagcttcccagtggggaccatcaccacgtgcgcaataattcagcgtagcacgtgcagcttcccagcgggatccatcaccacatgggcagtaattcagtgcagcccatgcagcttcccagcggggtccatcaccacctgcgcagtaattcagtgcaggcccgcgcagcttcccagcggggtccatcaccacctgcgcagtaattcagtgcagcacgtgcagcttcccagcgggatccatcaccacatgggcagtaattcagtgcggcccatgcagcttcccagcggggtccatcaccacctgcgcagtaattcagtgcagcccgtgcagcttcccagcggggtccatcaccacatgtgcagtaattcagtgcaggccatgcagcttctcagcggggtccatcaccacatgtgcagtaattcagtgcaggccatgcagcttctcagcggggtccatcaccacatgtgcatagctctgggtcactttaaagatcgcattacctgagtgctcagtgttgctgtaaggaaatgtcctgctgaagtttttttttgtttttttgttgttgttgttgagacggagtctcgctctgttgcccaggttggagtgcaatggcgcagtcttggctcactgcaagctccacctcctgggttcacgccattctcctgcctcagcttcccaagtagctgggactacaggcgcccgccaccacgcctggctgactttttgaatttttagtagagacggggttttaccgtgttagccaggatggtctccatctcctgacctcaggtgatctgcccgccttggcctcccgaagtgctgggattacaggcgtgagccaccatgcacggccagcctgctgaggttttcagactttatctctgtaactaacagttcaccatcagtttgttacctagtggtaccattataccatttagacattgcatttttgatgtgggaatgaattccacgttgagcccgtgttagatttccccgagtaccatacttagtcgtcttcctctgtgatgagtagatttgtagttttctagcagacattcactctctggttgtttgcctaacccctgggggtttgttttatttgtatcttgcttttttctttttgccactggcgtcccttcccaccctcagataatgactaccaacacacatatggtaagacaatcatgggtttgtcgtttctctgtgtttttggagtgcattacaaatgaaatatttctcgaaaatattttcaaacgtgaattcctgtgtgctttgtcggtagaaacgctgttagccgctgctgccccacacaccccagagctagctctgtgttagaagggtgtgtgcgcctcctgacgcacatccttgctgtgttccctcggttgccatgtcagggtggcccattgagccagggatgttttccgaattgactggattcatgggagcttccctcgattttaaattaaaggcagcacaggcatgtgtgggaggcccggtggggccctgtgcttcctgagagagccacaccaggcattcggtagatgtcagagaccatccctgcttaaatgcctcaggtatttaactagccgtacaagcagacaccagcgctgacctcggagaaagtccctcttcagcagccccttctgggtgacttctaaacagaaatcggcttcgttccttgtttagcctgacctctctctccctgtgtgtttgtccctcagactgctgggttcaaacacaaaagtcctgctatgtgtcctgtgcaccatttacctgctttagtcgttttcattcctctttactaaacactgctgttatccttcgtcatcacttaaatcagtttttaccaggtctatcttgagaaccaattcaaatattatttcactgttttaaaagctttaagttttctagaacttattctttgtcttcatttattttaattgaataattcctgaatgccaccaggccatgaacgtcatcaaacagagctacctgttgattcttttgtatcttttatgagattttcttccgagttgggcttacgtaagcatctcgcgtagcccttaagagagaactaagaggtagtgtcctgagcactgagattccaggctcctggcggctgccaatggcaatagcaagtcccctttttcccacacttgattttccagttttctctcacaaacaccaccctggttcactacaaccaccctatcagctggacgttcagatcatgtgaaagctgaggaaagagaagttcggacagactagacaccctgtgcggtgtcagctcccgagaggcagggcctgggtcatacccggacgtccggctccagacttcatggtgttgcccagtgcggcctctgggttgctctagttccaaatttcagcgtgaatgtgaacgtgcctcccaagagcccccggagatggacttcaggggcaaggacacgggcgccactgtcctaggagggcagcccggctgtgctcctgaatgaggtgctggcaacgcagtgccaggggcttctctcagccttcctggcagggtctctgcagcgtctccgccttctcggatccctggacccctggcgtgtccgcagtcagctgcacctggtggtcagtgggcactgtggctctgctgccttcctgggatccgaggatttctactagctcctgtttcctggtctcttccggctgtaccctccagcccctggctatgtcctggaaggtaccttgagcccccacggaacccgcgtgcagccccggggtgatgccagcactcagggaacttgggggcagtcctagtggctgacagccctcttggtccttacgtagcaatttggggttggggtgctcacccctgagaatctcccttccaaccaggatactcccaacggggttacagttcagaggccctctgggattgattgttcttgggtgagagctactttgttttaaagacctaaattattctataggaatatctatagatcctgtgtaggattggaggaacaatagaattatggacatctctttcaaaagttcaccaatggagcattttctgcactgacatcgtaagccatagtaacttctcattttgatgccacaaatgagaatgcgaagacaacagttatttgttgaacagcaagacattcctaagtgaacggttaaaagctcggaacgtgctttgatagacgtaggatgcgatgagagcagctgaaacacgagcggtccgcgtatgggccaggtgggaggcagagggatctgcacagggaggggaggcagtggatgccactcatgaccgtgaccttgagaaggcgcaagttatgctggccgtggatgtttttatacatcagagttaaatgggtctggtctgaggactttttgagcagaaagcttctataggaatacccattctcaaaggagggaggaagtgggggcatggggcttagcctgcagtggtggagggtggccagccccagaggcagatctgctgaaggagtgaggctttcgcactggtcaggttcttggctgagatgtgcctgtcacatgaggacagggttccacagaaatcagaaacaggagcttcactggggatggcgttgatgtcacttggaagaaaagggtccctgtgaaaagccctttgaaaaaggagattggtatcccagggatgcctgccacccccagaatctgatggaaataacgaccagcaattgtagtaataaactatccgcacatgttagtccattttcacatggctctgaagagctacctgagacagggtgatttaggaagaaaagaggtttaatcgagccacagttctgcaggctgcataggaagcatcgctggggaggcctcaggaaacttacaatcatggcggaaggcaaaggggaagcaaggcccttctttacaaggctgcaggagagagagagcaaaggggaaaatgctacacactttgaaacaaccagatctcatgagaactcactcgcccaccgtcaacgagatctgcaaggaggacgtccatgattcagtcacctcccaccaggctctccctccaacacacggggattataatttgagatgagatttgggtgaggacacaaagccaaaccacatcatggcagttcacctgggggccccacttcaggccaccaagggaataagagggctttccagagatgcgtttcaggatagctccacagtggactagcttccaaaggacgtggacacaggttagtaatgggtcagcgtttctcaggggccctgaccaaggtgcctgattctggattcacgatagctgtgctttgttcctcacctataaagcttacagctgtggcccatgtgctctgcaggaccaggcatcctgaggcctaactccttatcccagttctgccattaccccctaaacccagggagccccagctgggagcttagaaaggcagtttctcggctcacagcagggagaggggacagtgaggaggccgtgtgagttgactgcagttatcacctgtggcgctgttggtgacacacactgcttcacagggcacccttgagttcatgtcttgctgccatctaactctttcagagttctgtgttgggatggccaaggtgaggcctgggggaggaagaggagagctgggcagcgtcaggggcttttcctccaggcccagctgatgtggttgtctgggtgcaaagccgccctcagctgctgtggaggcaccacttggctgaaagcatcagcttccagttacagcacagcagcctcccgccctccagcaccttgctggccacatgtgcttgtaggctgctgccaagccacagctgttcctagaggcatgatattttcctgccccagaagttaagccacaaagagacggcactttttggtgagtgtgaaacaggcttctcacccgggctctgctgacattggggccagatgtacatcctcgtgggccactgtcgtgtgcactcagcagcccctccacccccccatccaaagctagcagaccccacgccccagaaatgtctccaccacggccaggtgtccctgggggcaaggctgccccagccgagaaccacaagcatgtgtagatctgagtgacactgtaggccaggcatttccaagccagaaggaggaggcccacttctgatcacaatgaggaagtgagggaaaaactgaaggatgtgttgatgggggcccctaagaagcggtgttcactacaaaaggtcctaacacttttttctataatctacaaatgagatgttatcctgttatcccactgaccatgtgggaggactgtagcccacaccctccctcagctaaatcaaggggtatggtgatgggtgtgttgttttggttgaaactgaattctgaagaacagccatttgtattccagctttttaagagacagagtctgtgctctgtcgcccacgttggagtgtagtggcgtgatctctgctcactgcaacctccgcctcccgggctcaagcaattctcctgcctcagcctccctagtggctgagattacaggcaggcgccgctacgcccggctaatgtttgtattcttagtagagacggggtttcaccatgttggccaggctggtctcaaactcttgacctcatgatccgcccacctcggcctcccaaagcgctgggattacaggcatgagccaccacacccggcccgctttttaattctttataaaataaaattccctgcgaggtgcagttcatggaatccgataaactagaaatcgtctgggccacagcgcaggagcgtcccaaaggaaagcaggttctcccgaaacaagtttccagtcgggggttttccccaaggcggggggtggtctgggcagcagccctttctggcctgtgcctcgtgcggtagagaggcgtgctgtcctcacgggtcgggcacgcggtcctcacgggtgtgtctgtgtctgtgctgcgttgccagctggcagctcgtgggtcccactgaccttccctcctccacggccacctgggcaccactgctggcggatctgtggttctggccgcacgcggggcagcctctgtccagccctgtcctgtctgccggcttgtcttctctgtcctgagggaggttccccgagggaagcccccaggcttccccctctgcatgggtgcctggggtgtttcctctgcatttactcgcagaacgttcccgccgctgttcttcaacagcaggcaggagtctgagctgagttcagaagggaacagacacagtctgtgagtttgttcctgaaacccgtggaatgtagctgggtactcaggcaactgtcttttctacgtaaaacacaaaacagaaaaaggaggtttgcgtgtacccgagtttgcattatggatatttaaatgccagctgtgagggagtttttgtgctcagtttgagaccttgggacgtctgttgtggctgagagcattgagcagggccagcgtcaggagcgggcagcaagttgcagataggcaggctctgagcccatcaccaagccacagaactggtggtgggagatgcagccgggaaatgggggcgtcctgccgtgctctggggagttgctgcatcttcttttacgggataataagaaaatatagtgcttatatctttggggtttgaagtgttggcacacaagaaaaatgaggtgtattttctaaaactcttgattgtgaaagagaaaaaaaaatacataaaaacgagatgacttggactattttccccaaacagatatttggaaactggacgtttggaacgctggtattcaccgtgatggtgttcacagttacactaaaggtaagtggtctcgcgctcacgttcctcccccagccacagtgaacccctgcagtgtaggcctcacgcgctctgagctctctgaattataactctgtactgaggctggaagccactctccacccagccttggctggctcctggggcacccctgggcatccttgtcctgctgtttagacaagtaatgcacagccactcagcacacccggccaccccatgtgcaaaccccagagctacaccggaggtaacctcgggagcaagctgcttctttgtgaaagaattcaggctagaattgttttcagtggcaagtagccctccccccagcgccatcaaaatacactttaattgaaacaaattaatgtattttgaaaaatttcactctttaaagttcagtgaaattatatacagaatatatcattatgaaatctcaaaacctatcagactgagtcttaaaaagtgataccaaaacattcctaaggtgattttcttagatagtgatgtaaacaacacctgactctaaagtaactttctggccaggcatagtggctcacacctgtagttccaacactttgggaggccaaggtggatggatcacctgaggtcagcagttcgagaccagcctggccaacatggcaaaaccccatctttactaaaaacacaaaaagtagccgggcatggtggcacgcgcctgtaatcccagctacttgggaggctgaggcacgagaatcgcttgaacccgggaggtggaggttgcagtgagccaagatcgcaccactgcactccagcctgggcgacagagcgagactgtctcaaaaaaattttaagaagtaactttcttcagtagagacataaagaacaccttaatctgaatgactttcttcggtgacgatataaacaacaccttggtctgtggcccgcatgctgccatctgggaaatacatccatggctcccttacctaggacccagggctgtggcgtccccacattcttcctctccactcacactgtgaggtgtggctttgtcttcctgagcagtgtgaggtgtggctttgtcttcctgagcagtgtgagctgtggctttgtctcccgaacggtgtgaggtgtggctttgtcttcctgagcggtgtgaggtgtggctttgtcttcctgagcggtgtgaggtgtggctttgtcttcctgagcggtgtgaggtgtggctttgtcttcctgagcggtgtgaggtgtggctttgtcttctggagcggtgtgaggtgtggctttgtcttcctgagtggtgtgaggtgtggctttgtctccttaatggtgtgaggtgtggctttgtcttcctgaacggtgtgaggtgtggctttgtcttcctgagtggtgtgaggtgtggctttgtcttcctgagcggtgtgaggtgtggctttgtcttcctgagtggtgtgaggtgtggctttgtctccttaatggtgtgaggtgtggctttgtcttcctgagcggtgtgaggtgtggctttgtcttcctgaacagtgtgaggtgtggctttgtcttcctgagcggtgtgaggtgtggctttgtcttcctgagcggtgtgaggtgtggctttgtcttcctgagcggtgtgaggtgtggctttgtcttcctgagccgtgttttgcaggcattgagtcgtcattgctgggtcttgcgtttggtttagtttctcgtcaccccccggctctctgtcctgcccatcacgatcattctcactgctcagatgacaccgttaactgcccttttttttttccttttagcttgcattggacacacactactggacttggatcaaccattttgtcatctgggggtcgctgctgttctacgttgtcttttcgcttctctggggaggagtgatctggtaaatatctgataagtagctgataatctgataaatatcatgtggttgttatttttttatcaagggttgaagacacattttccgtgcggccctgttggttggggcaagtgtttgttgaatggctgctgtgtgctgggtgtcgtggggtcctgggatacagtcgggggcaagacaccggggggttcctgctccggtgacttgcatcttccgggggagaaagacgctaactgataacagcttgtgacgagttatacggaggaacagaccaggattccgcaccaggggacccatgtcagattgaaaggccagaggtgacttttcagaaacagtcatttgaaacctggaagaagagcgccatcatcacagcaagtcccagctggtaaccgcctcccacaacgaggcactggccaggcattcgacaggtcctgtctcactccatcctcacgccccgcagcaagatggggcccaggcatggtggggctggaccttgcccgcagcagcctgactcatcggggagcctctggtttgggggagagcagcaggcacgcaggcccgggcgggaggaggtcctccgtgagtgggagccgtggccagcggagaggggcccggaccaggctgcagagcaggcatggtggcctcctggaccgccggccgtgaggatcctggctcgaggctgtcgtggtcagtcgaggcagagcacagcagagttgagtggctcttttaaaaaccccacggtggctgcgtgttgagctggtgagagcgacataggcagggtggtcagtctagagactgtcgctgtaagccaggaaacgacgctgagtggtatgggcccagggccaggtcccagtctcagccccagcgcagcagcctctgccacagccctctgcagacctggggtcagtagccggcctagggaaagccagcaacccactcaggatccctcagggcccctgacctgggcgggactctcagcccaggaagagtccctccggattctctcgttcagccagcggcccctggtggccccaagttgcattacacagtctcagagatgacagcccagcttggagggtgtcaggcaccctgtcagccccagagaaacctgcttagctctagagagcccagcccggctctggagagcccggccattctaacagccctgaaggcgatggctctgtaagaggaagattccatcccaaacctctctgaccagctcctgggctttgtagccaaggagccacagcccgtcagccttggtagaaccacagcctctcacattgtttcctaaaacattgaccccacgtctttgatgtgctgggagctcaccatgtcaccaccgcttggtgatgagaccccatcctcctgcccgccaccagcaccacgtgggtgcccccagccccatcccaggtctgccagcagctgcgtgtccctcccgttacccaccatgccctgcttccgtttccctcctgttgtccacacaccagtttcactgtgcttcctggagctggggccctatctctgtgtctctgccaccatccgtagtgcctgggatgtgaaaggcgatcaggaaacgttaccggaaggcacgtatagacgtggacctgtgggctcgggctggctgcgggtcactggtccctgcatccttgccagcctccctcatggaggctgacgcagacgtctttgaatcatcctctttctggggagagaagtcattgcttgctctgtactgacgaccagtgctcgggacgtccttcccatccgagacttcaagatagaaaaacatccctatttcaatccctttgtgttttgttttttgttttttttttttttgcttctgtgaaactgaacttcagagacttctatgtcccatttgagatgacttcatagaattccttctcccgttcctcttaccccagcattaccgggaggttcagtgttcattttttatatgataaattcagagcaggctccgtggcttgccaagcaactctcactgacaaaagtgtaaactccctgaacagacggcctctccagtgagtagagaggccagccccagggagtacatgcctcaccagcggcttctcttccctgcccctcaggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccaggtacggagtgtccccagccggggcgggggtgcctcagggccctggccttaggattgggagatgaccgttttgaaagacagtgtgaaaggtttggatttcatgaaacgtgatcagttcaggtatcactaatgagtgtcctgacggtgcatgatgttaaacatcaggtacatttgcgatgaccgatgtctaattttatgtttcaacctaaacagtcatctgaaatgagacacaaataagagaaaaaagactgatgcaaaaggcaaattatttcatgtaaatggaaaccttttttaaaattaatcattactttaaaaggttgaattacataatttttaaggatggtaaatctggctggaaacggtagcatctgtatcaggaaatgctggtattggtggagctgcttattttacacactcccaagttttaggcacaagcagaattctgggtccagggaagacgtgacgatgccgagtgtccccccaggtgcagggtttggcaggtgtgaggacttagctcccggtcccccatccttttcagcagctggcctctgccttcaagctcaaccctaaatcagaggcagtgaccacgacccacctctgctgctttactgggaagcctgcctgtcctcagagggccgctgcacctgtcacggtccctcaggactctattaacaatgcaagttttcaagtttcatccccgaaatttccaatcactccttgaggtggagccctggactgggcagtgctgaagcccaatggggaaatgaggggtgggggcccctggcagtggctgctcctgcagggtgtgaggctccccaggtgggaggaagacggggagtgagtgggggccggggccccagccctgactcactcacgtagctcagacacccgggggctggctcccagcggtgctgctgtgctgggagggaagacaggttgccctcccttggggggcacagcctcacccaccacccacctccaacaatcagaatgggaccctggcttgagagctttcttgggacattggtgccgatttgaaatgttgaaaccgatgccaccagttcccggcactccctccttcatgcctcctgccacagtttgtaaaatcagagcgagcaaaactcgtggtgaagagactgcctctcaatgtagtgaaaatgtccacacacagctccactgactcgggggccacaggcaggagaaacgcagcagaacgtgccagttggctgcttataagaaggtcccactgaggggcctctgtgcaggaggggagacagtgggagcaggagccggggccctggctgagactccgcggcccccagtgcttcaggggaaactcaccggccccaagcagccactcactgcccagccctgcctgtggcccgagaagcagctgtccagtggtggttttctctaagcacggtccttggttactgagctctttagctgtgcagttccacagcgggcacacgtgttcatgacagggctctgtgcatgggacacgtgttcataaccacatcccatacatggggacgtggcagacacacatgtaacaaggacatcaggcacagaagagacagcagggctgggggtctgaccccgagagagagcaggtgcagcttgggggtgtctgctgggcccctagctgtggccacagtggtgtggcttggggtttgcacgagtctcagccccacctggcccctgggtgcatgtggctgcagaggtgcttggtcaaagatgcctgagcaggcaggagttgaactcggggggttaggagggcctctccccgcaggagtctgggctcttccatgcactgtgcacgcagcctccagagtcggggctgccgagggccacgcccccggatgtgtctgaccacaggccctctgctctgcaactcatctccaggatgggtgggcactttgggaatgccagtgaggaccctccccgtcccaccctttgtttagaagcccctgtattgctgtgggtctctgcgtcccacaagagccccgggaatgcttatgaacagctacacagcgggacctgcagaaggcataaagcagggggtgggaggggctggcgggtcacggtggggggcaccagtgtccgcccagagtgaccagaagaacttgcacgtggtggcgagcctctgactaactcagctctgtctcttgtttctctttccttcccatttccttccgtcttccgaccgctttgcctaaatcctcacaccttgttcacacacccctgtgtgcgtggccgctgacctcgggactaagactaagagccagtgcctttctgtcgagcagtcaaccatctttatgctttctcagacttccagcagcctgagtttctgatggaacaaggtgatgctcctctgccttccacgcacctgggatggtagacacggggcagcagggccatgcccatcaccagagccctgagtccacgtgctctgacgcagcgtccaccaggcgctgggtacagcagcctcacgtcgggaagtcccgccaccacttacaccttctcatgcacagactgatcatgggctgtgctttccatcagtcacagttaaccagggtttctccctcagcgtccgtgcagcctcagaacccacctgtgtgagggttcagacacagctgacagcggagagctggccacatgacccctcacacaggtgtcagaggggttcctaagcaggaaggtgtgagagtttgcaattcacaggtcatccaggctctgagctcacacacccttccctctgcagcctgtagagcgtggatcacaaggcctcctccctcacgcacccacttctgtgcccattctgcagctggaaagactgagggcagctaggataacacggtttgctcaggacccatgcacatttcagaaaaggggagccaggctgagccacacaactggagacaaagaggggacggaagtgtttggtgtcaaatgtttgaccaaattccctttttactgttttttaaatgaaaacctcattgtttttcaaaaaagccttctattaataatttgctttaaaaatgacgaccttggcctttctgggcaatgtagaggcgttcacacgccatttttctgcggtggtgtccatgataagagccgagattgcaggggcctgcacgccgtcctgaagtcgcgttctgtcttttagccgtgtgctcctgcaccaaataccgccttcacgcatgcctccaaatcagtgatgctttgaaaatgcatacttggtattactgttttaccaaatgcagcttagaaaaatgcccaaagcagaaaaaggcttcttttccctttaataacatcatcttctatatattttaaacaggatttttaactgacaaaatggtccttttttaagtccaagcaattaatcagaatcaacagttttctaatttagtgtcatcagaatttgttagattaaattgcagaatttcatctcaccatttctgtacttgaagacatttaggatgaaattattaggaacattttaatgactcataagaggtccttaagaaactgattaaatcatgccaactctgagctaaaaataagcattctaacgattcatgtagtttgttgagagctgatttgcttctgagcatgtacggaagctgagcccggctgcgtagagacagtggcacggagtttctcctgccccctgcgaggccttgggccccggcatgacccccacagacagggccggcgtccacacttgaacagaaagcgcctgcagccagcacatgcccggcgcacacgggaacacgccgtggcgccgagaccacctgcgttctgcaaaactttggaggaataaacgtgtcactagtcctcacgtggggcatatgttacttccagtggatggctttcttttaacctgttcctacggaaaagaaaagcatcacaggcctcagatgtatatgttatatatgtgcgatttgcacatatatgcccgtgctggcatctctgcgtatctgcatgcagttcacttctccgtcactgtccccaggaagggtggcagcctcatcctctgtttcctacttctcctcacctgggcgtttgcccattcagacgtgcaattgtgcaattccaagcccgcagttcttcagctcctgtgcttcccttattccttgaataaggctgggctacaagatctcagtggagttctgtgagcacgctggactcaggaaagtccgtcgcagggccctggtagagcggttactggagctcgctgtctgccgtggaagtgggcgtgtggctgaacgtgtggcttcaggattccagcggtgcctggtagaccttccagccgagggacctcagaccctctgcctcccgcgggtgcatggcccgtccctgagcctgtcgctgtctcagttctgggctcgggcccctcatgggagcggccctgctgggacagtgttttcccaagacgccccaagccctcgccctggcagctccatgacaccccatgcagactccaacaggggcttcgagcctcttcctgctggggtcccacggatggtgcaggcagaggcccgagcactcctggtggccccgtgtggcccacgtcgctcagtatctttcctcgccttgcagaggggtgtgaagcacaaggctccagtccaggccgcacagagcagcgatgggcccctcctgaaggacctcctacggcggccaaggcgcagttagctccacgctaggtaactgtgcggctgctggacgccgcccgtgtgctgtgactgtcagacccgtttttcctccaaagttgtgctgtgctgtgctgtctttgataacaaaggttcacggtgagaaagagcagccctctttacacacacatgcatttgctgtcccaggtaagtaacacgcctgagggcaagctgaccacacatggaacatgctgtgcacacacacgtgtgcacactcaccccacacgcacggcacacagcctgaccagacccagcatcgtcagacacaggctcacgatcctggtctttcgggggacacagcttcacttaaaaggcccatcaggaaggaccgtgctttgaaatcaaacgtggttattgcatggtttgtgtggaactggggcccaggcaggtgtgagtgcaggtcttctgtgtgccagccggagcacatagcttgtcgcctctccaacagacatggaggccatgaagacatctgctcctgccagcatccgccgctgccccctggtctaaaagtgggctgacctggggacggcccctcatcagacagatgcgtgctgccggcctcctgccgctccccttgctggtcagacccacagggcccgtgcacatccggggccccagtgggctgtcagaagccatgcaggccccatccgtatggtgacatcctaggcaacatgtcaaggggatgcaagctgggcacgtccagtactaaatcaacccggtccctgtggggtggggcctgccttccctggggcagtgagttcgccttttgttcaagggtctctgggtaccggtatggcgttcgagctcactgcacaggaagccagctacagggaggaagctcgtaggtttcccgtccatggcctgtatccctggggcccctgggttcttccctgggatggtgggacagggggacggtcactctgttggtactgaaaaggagaggccctcattcctagacagagacccctcgcctccatatggcttctctggtggggtggatcccgcccggcctgccctcaggacgagggtgtgtcctgagttgagtctagcagttcctgcaggaggcgatggtagtgagtgcatcccagagtggctcaggtcaccccaggcagccccgtgggtatccctgagactgaccatgtgtctcgttctctcagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 468 - DNA, 196840 bp, Homo sapiens; identical to SEQ ID NO: 467

SEQ ID NO: 469 - DNA, 697947 bp, Homo sapiens
aaataaacgtggcgggacgtatgtgtcatggcgctctccatctaaagtctgtgcagcttccggagagtggcgggttgattttctcactttggactggtttttacttcccgacttctgggtaagggtggccgatgggtccatgtggggcagagtgtggccacagctccttttatggccaagccttgtttctccagtttcagtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcagtaagaagttacaagtagtatggagcatcattaatcctgctgtataaagcagtcttttatggagtctgattccttttaagtaaagaatccttacagtggttttgtgaactttttgggtgcttacttttcctaatcaatttttattttccagactcatctttcaagaggactttagactaattgcagataattaaggtactgatttattttaaaccttttatgtttgagtgctgtgcgtatttctgcatgttagaaaatgcagagaggtagcctaatgttttagctatttgccactatcatgttatggaaacattgtgctttacatagcattaaatcgaagagatattttcatttattttacttaacctttcattttcattcaccagcattgaccatgtccacttttttgagatgcccttttcatttgccttccatggcccatggatttttttccttgtctggtggctgcttcttggaatccattataagctgattttcctttatctggcagttaaatttggagtctctcaagtcgtggtcttgtaccttctcctacctctgttctctttttcttcccctctgggtgatgtaatccacatgcctgtcaacagttatttgtctttttgattctacccatcctaatgggtatgaagtggtgtattattgtggtttggatttccatttccctgatggctcatgatgttgacatcttttcatgtgcttatcagccatttgtatgtgtgtgtttttgagacacggcttccctatgccacccaggccagagtgcagtggctcgattacggctcactgcagccttgaccacctggtctcaagtgatcccacttcagcctcccaagtagctgggactacaggtgcatgccaccatgcccggctaaattttacttttttttttttttttgtagcgatagggtccgtgttgcctaggctctggccttgtactcctggcctgaagtgatcctgccaccttggcttcccagtgttgggattataggcatgagcctctgcacctggcccatttctgtatcttcttcatctaatctgtttttccttttgttgcttgtgcttttcatttcttagctaagaaagaagggcctactctaacatcataaagatttgtgcttatgtttttttctaagagtttcataatgttagctcctaaatttaggtctatgatccattttcggttaatttttgtatatgatgtgaaatgtgaaatagggctccaactttattttttacatgttgctatccagttatcccagtgtcatttgttgaaaaaaaaactacgctttcccccttgaattgtctaggttatgtatatttgacatacattctaggtggtttttatgaaagaataattctgggacagtgattatcaaactttaattcagatcaaaatcacctagagggcctgttaaatattgctaggttttactcaaaatatctgatttagtatgtctggagtggagttcaagaattttcatttctggctgggcatggtggctcatgcctgtaatcccatactttaggggccaagatgggaggagtttgagaccagcctggacaacaaagcgagaccttgtttttacaaaaaaactgaaaaagaaaaaatgttcatttctaacaagttccccatgatgctactccagctgatgtggaaactacactttgaaaaccactggacattgctttgcaactgtggctgtacacacatgagaatgactggaaagtttttaaaagatattgatgcccaggctccattctcagagattcattcagctatcttggggcttagttgggaattttcttttttttcttttgtttttgtttttgttttgagacagagtctcgctctgtcgcccaggctggagtgcagtggcgtgatctcggctcactgcaagcttagttgggaattttcaaaagctcttcaggtgaatagaatgagtgttgaagattgagaaccattactgtggaatcgtggttcttaattagggatctatagtggaattacctggacagtttctatgttcacatacttcagttctactcttggagattctaattcagaatggaacctggagatttgatatgatgaaaagcttcccgctgggtgcagtggctcacgcctgtaatcccagcactttgggaggccaaggcaggtggatcacctgaggttgggagttcaagaccagcctgaccaacatggtgaaaccccgtctctactaaaaatacaaaattagctgggcgtggtggcaggtgcctgtaatcccagctactcgggaggctgaggcaggagaattgcttgaacccaggaggcacaggttgcagtgagccgagatcgtgccattgcactccagcctgggcagcaagagtgaaactctgtctcataattacaaaaaaaaaaaaaaaaagcctccctaataactcacctatgtaagtaaccactgctctaggatattgcatcctccttcttcctatcattttgagtattttccttttcactgactctatttttattccctttatcaaatttgatttcctctacctttgagaaaaatttttaatgatccttttgctccatttagctattacgctgctttccttttattctcaaactttcatttccatatgatttaattaaaaatttctgaaggctaaacaattccctctatcagtctatcagtttgttcaaagtaaaacctttagcttattaatagtgatgagtgagattatttaggtacttatgatatacagccaggtttatgctacataatgctgatatgcagcgttatatttatcttttttgagtgaatatctccaaatgaaattgctggctcgaaggatatacatatgtttggtataattgtcaggttgccctccagaaggggtgtaccagtttttctgtgctttcagctaacagagtttttgtcagctttgtatcagtgaggcagctgaaaaataacttattgtttcaatacttgttgttagtgtggttgagcattctttcctctttttttttttttcttttctgggtatttgtatttcttaagtgaactgcctgtttttcctttacgcattgttttctggaatgtggttacttattagtgtcacattagattcttgcattgtttgtactttgccagtgaggcaaagccatagtgggaagagcatggtattgagaggatgccaaggttctgatttctagctctatcaatgtacaaatccttttgcttcagtggactccagctctgtaagataagaagcttagcaacttctgcttctctaactctaatgatatgggatgtctattgcagtggattcctttcattcctctttttcctttctatttctcttcagtggatccatacacacttgtatatgggatggcaaaattgtgtaattaaaaaatatggcttttaattaatgttatttaattattcatgatctgtcagtagttcttccgcattccaaaggcactacctggtcctagcctctctcatttaattatttcatagaagagtggtgatagaagaaatcctaggggttgggcatttacttcagcttcccacccagtgtagaatttcctgctgtgtcatagaaagactagctaaattcaacttaagcattgtgttcattcatttagtcagtaactattgtgtgcctgctatgtgtcaggcattgttagaggtgttgtagagacagtactgaaaaagagatgatgcctttgtgcttaacaagcttacattgtaatgaggaagatacaattatatatgtggtgtcaggtaggtaagcacaatgaagaaacatgaaacaaaagcagggttagaagcagtgaaagtgtgggcatgcttgggcagcgtggttattttagataaggtagtaggaaaggcctctccgaggagatgttgtttgagtgaagaagtgggtgggaagacatacttatctgggggctgatattctggcagaggaatagcaattatgaaggctcccgagtcagaaactaatttggcatactcagaatatctatatccatatattgcccgactgtgtagtctgcagtaaaagtatttattgagaacctgcaatgtgctagacatagttctaggcacctgggataaaacagtgaacacctcacacgaaaacctttaccctcacgaagtatgtattctagtaagataaacagttaaaaaattattaaaacattttaagcagatgattaaatgctacagtttaaaaaaaggcaggaaaggggcataggaagagggtgtgtggtgaggtgggggtgttggttggaaagtcctctcttgttacacttgagcaaagtccttaagggcttgagtgagtgagccattcaggtgtcttaagtaagagcattccaggcaagaataagactgtgaaatgaatgcatatctagtgggtacgaaataacaaagcctgcatgactgaggggagcgtggtaggaagtggggccagagatgcagcaggaggctgattatatatgtcattgcagatctttgtagtgattttggctttttactctgatatggaataccactggaagggtttgattgagaagcttgagatgaacttaggttttaaagggatccctgacttctgtgctgaaaatgttcttgtagagtttaaggatagaagcaaggatattagggattgcaataatccagacaagaggtgatgttggtttggaccaagagtgtaacagtgggtatggtcacaaatagattctgaatatattttgaaggtacagccaacaggatgttgttgattgattggatttagggtgacagaaagaggggagtgcaggatttttggcctgagcagtagaagattgggattgtcttttttttttttttgagacagagtctcactctgttggccgggctggagtgcagtggtgagatcttggctcactgcaacctctgcctcctgggctcaggcaattctcctgcctcagcctcccaagtagctggggttacaggcgctcgccactatgcctggctaattttttgtatttttagtagagatggggtttcaccatgttggacaggctggtcttgaactcctgaccttgtgattcacccacctcggcctcccaaagtgctgggattacaaacatgagccactgcgcccagccaggattgccattaaatgaaatgggagaagttgtaagaggatctggtaaggtagggagaagatcaggaattctgtttcgactttgactttttttttttttgggatggtgcttcgccctttgtcgcccaggctggagtgcagtggtgcaatctcagctcactgcaacctctgcctcctgggttcaagcggttcttctgtttcagtctcccgagtaggtgggattgcaggtgcccaccaccatgcctggctaatttttgtatttttagtagagacgaggtgtcaccatgttggccaggctgacctccaactcctgacctcaggtgatccatccgcctcagcctcccaaagtgttgggattacaggcgtgagccaccatgcccagccctgttttaactttttaagtttgaaggaattattagacattcaagcagtggtgtggaataggcagttgaacgtctgagtctgaagctcgggggaagaatggggctggttatgtaagcatagacgtagttcatatttcaaggccatgggactggatgaggtcacctagggagtgcctgaaactagagaagagttcctgtaacagagccatgggggcattctaatggtgagaagttggagagatgagcagaggagactggagctaggagagtgtggcatcctggaaactagtgcaatttcttactgcagttcttcagtctttaataatgcacactgtgaatgggtaaggacgcagaattttctaaatttatttgaccacagaaccatttttttttccagataggtagtaaataattagaagcaatttgggaaagactaacctggttcatttcaccctacctggatggctgagttggccagggctcttttttgcaagaacagaatacccacctcaaactgatttaagccacaggctcgcatgactgggcagagcagggctgcatttggcttcaggcatttgttggattcagatgctcaaataatgtcagtatggttctttatctttctagatcttattaggcttcattccttaagtaggcttcctccctgtagcagacaagagggctctggtatccccaagttgacatcctcccaacttagccacttcagtgacaagagaagctatcttctgttaacactagcgtagaatcctcacagtgattcttattggctaggcttctcatgactgaccttgaactggtcattgtggccaggaggatgagttaccctggcaagcttgggtcatgttccccattccagtgtctagggaaagggaagtctgtgattgacagtcttttttttttttgagacagagtttcgctcttgttgcccaggctggagtgcaatggcgcgatctcggctaaccaaaacctctgcctcccgggttcaagcaattctcctgtctcagcctcctgagtagctgggattacaggcatgtgccaccacgcccggctaattttgtatttttagtagagacagggtttctctatgttggtcaggctggtcatgaactcccaacctcaggtgatctgtccgccttggcctcccaaagtgttgggattactggcgtgagccaccgtttccggcaattgacagtcttaccatgaccacgtggtacgtatgttaactataatccagccaatccttgatggattgatgtttggtttatttctaatctttggttcttactgacaatataaagctagctgagatttgaacacagatttttcggatacccagtgcataatttgtcatagctgtaatgaatacattacagaggaaaggagcctggctggctgccactctgttaattgaatgatgtgaatggaaggatgggaatccagcaaatgagaaggaaaattcatcagaaagctttgaggacaactgaaagaatgtaagatccttaacactgcaactcagatgaggaacagtggtcattcaatatacacatactaagtaggtagtagagtaccacacagtgcgtgggcttggactcatctgtcatggtatccttgtttagcttctttgggcaagttaatttatctgtgtttcagtttgttcatctttaaagcgaggatagtaatactatctacctagtaagagttgttgtgaatggttgatgagatgaccctataaaggacttgccttgtgtctggatatagtattagtggtagtactatcagtaagtatatacgagtgtattccccccccatttttttcttaactattttattctaacataattaccgctttacctgcagttgtaaaacttatgcagagatccttgtacactttacccaggtctcccgttggtaacatcttgcaaaactacaatacaatacagtatcacaaccaggatattgacattgatacagtcaggatgcaaaacatttccatcatcacaaggattcctcatgttgctcttttatagtcatacccattctcctctcaccctgttctttctttaatccctggcaactactattctgttctccatttccataattttctcatttcaagcatgttatataaaagtgatcatacagaatgtaaccttttgggattgaatttcttcattcagcataattctcaggagagtcatccaggttgatgcatatgtcattagtacatttctttttattgctcaatagtgttccatggtatggatgtaccacactttgtttaaccattcaccttttgaatggcatccaggtggtttccagatttgggctattacaaagaaagctgctgtgaacattcatgtacaggtctttgtctgaatacaagtctttatttctcttggataattgcccaggagtacaattgctgggttgcatcacagtcatatgatttgtttaagaaaacaccaaactgtttactggagtggctataccatttttcattccctccaggactgtatgaatgatgcagtttctttgcatccttgccggtgtttggtggtttcactgttgtctgttttatccattctgaaaggtgtatactgatacctcattgtggttttagtttccatttctgtgcttatttgccctctgtatattctcttgaaatgtcttttgtcattttctttttacggttgtgttttgacactagttctttgtcagatatgtggtttgcaaatattttcttccactctgtagtttgactgtttgacttttcagcctcttaatagggtctttcttaaagcaaaagttttaaattttaatgacattcaatttattactttttctttttatggattgtgcttttggtgtcacatctggtaactttttacctatccctaagtccagaagattttctcctgtgatttttttctaaaagttttataatattatgttttacattttttttttttttttttttttgagacagagtctcactgtgtcacccaggctggagtgcagtggtacaatcttggcttactgcaacctctgccttgtgggttcaagcaattctcctgcctcagcctcccaagtagctgggattacaggcgtgcaccaacacactcagctaattttttgtatttttagtagagacgcggtgtcaccatgttggccaggctgttcttgaactcctgacctcaagtgatccacacgcctcggcctgccagagtgctgggattataggtgtgagccactgcgcccagcctatgttttacatttaagtctatgatccattttgaattaatttttgtataaggtgcaagacttaggtcaaggttcattttttgcctataaatgtctgcttgctccagcacgaattgtttaaaaagcaatctttcctccatttaattgcttttgtggaatatttgtgtaggtctgtttctgggttttctgttatgttccattgatctatatttctatccctctaccaataccacggtctcaattatagctatctaataagtcttaaaattgggtagaccaggccgggcgcagtggctcacgcctgtaatcccagcactttgggaggccgagacgggcggatcgcgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccaggaggcggagcttgcagtgagtcgagatcgcgccactgcactccagcctgggccacagagcgaaactccgtctcaaaaaaaaaaaaaaaaaaaaaaaaaattgggtagaccagttcttcttactttactcttctcaaaattgttttaaatatattagtttctgtacatttccatataaaatttaggatagtcttatctatacctacaaaaaaatcttcctgggattttgatagggattattttaaacttgtgtatcagtttggtctccactgacactgcaaaacttcattactggtcggttggttggtttgaatgtccaggatccctccaggtccttctctgattctacactagtggagtgtgttggggtgcttgattgtaggtagaagtccaagctctccccacttggcctttgtagcgtgcctgggggtgggattacagttttgtgtgtgtgtgtgtgtgtgtgtgtgtgtttgtgtttggctggagtagaatgattattatctaaaacttttctgtcttcctaggctgccctttgtatagttctttaacgagaaagcaggcttttattggggggttttattgttggcatctcttgccatttctgattgctgggatctttagtgagctgtaggaggcagaagaaaacccaaggaactcatcatattccttgggtcctgaggttcatagccagtctgccttatgcttgttttatatataatgtccagagttttatttgtattttgctggcggggcagggaaaaatgtgcttatcttcttgcaagctgtgtccacattttcttcttttaattataaaaattttgaatatttagaaaagtcgtataggataatgaacatgaacctatctagtttctagttttaagagttgtaaatgcttttcagtatgtcttaatctattttttcttcttttttgagatggagttttgctctgttgcccaggctggagtgcagtggtgcactctcgactcactgcaacctctgcctcctgggttccagcgattctccttcctcagcctcccaagtagctaaaactgcaggtgtacaccaccatgcctggctaattttgtacttttaaaagagatggggtttcaccatgttggccaggctggtctcaaacgcctgacctcaagttatgcgcccacctccccaaagtgctgggattacaggcataagccacccaaagtgctgggattacaggcataagccactgtggctagccagtctattttttctgaggtccttttaaagtaaattatagacataatgacatttcacttctaaatattcaatatgcatctctaaaaaataaaatttttgaatataaggacaatactttatatcgaatgatttataataacttcttcatattatctaatatccagcttatattctgatttccctagttatacccaaaatttcttatagcttgacagacaaagaagaaacaatcaagaacatgaactgcattttgttgttaggcttttacgcttcctgttatctgaaacagttcctctcctactttttcctacttgacattgatttgttgaagaaatagttcctgttgaaccttggaatgtcccattgtcattagggttttgtctgattgtttcattgtgtttcttttttcaatatacccaagatagtacttcatccttgtgtttctttatctcttgtattttctataaatttgaagttagatccaaaggcttgattagattcaaatttggtgagaatatttcataaatgatgctacgctaagcagattttcataagttgattttatttataacttttatgtggtagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacaggtaagcttttttccttgaaattatattcattttctttttttttcttttgagacagagtcttgctctgtcgcccaggctggagtgcagtggtgtgatctcggttcactgcaacctcctcctcctggattcaagctattctcctgcctctgcctccctagtagctgtgattacaggcacacaccaccatacctggctattttttgtatttttagtagagatggggtttcaccatgttggccaggctggtcttgaactcctaacctcaggtgatctgcccaccttggcctcccaaagtactgggattactggcctgagccactgagcacggccgaaattatattcattttcattccagggagaagctgacgctactggtctgtgtgatatatataatgtctcttcattagaatctttgaacttttgataggaaatacaagttgagtatcacttatctgaaatgcttgagaccagaagtgtttcagatatcacatttttttttttggatttcggaatatttgcattacatactttccagttgagtattcctaatccaaacatctgaaatgctccagtgagcatcctttgagtatcattttggcactcaaaaagtttcagattttagagcattgtggattttgaatttttgaattaaagaaactcaacctgtatgtagattttttttttatttgaatgattttaaatttggcaaggtaattggttaaaaagaaatgagatgtcaaattggatgttcctagaagatagcctcgggcaatagggatctcttgggtattactgtagttgatatgtaagtctgtgttatttccaaataaaatttttaccagagtttgtgattcttatgagacagtagtattttggacatttgaattttcttagctgattttcaaatacctgtggatcaggtaaaggcagtgggcacaaataaattattgccctatttacgctattatagtagatctctagtccgtgaaattttgatacaacctaaccagaaaggataatgtaattatatggttttaataagcctatatttgtttatctagtcaactgctgaactttataatctgcttattttgttgggaaactaagcttttaaattcttggaatttaaaatttgcttatattttaatgactgaagtttataaaatttgtcctaaatgtgtccttaaggtaatttttatttacttataaattattagagcaatccaagttgaaagtccttttttcccctaaaagttatttttagaactctgattttatagagtgcttttaataatgctttaggatgacggtttttaactttgattaagttacttatatctgtaagttttaaggaagctacagattgcaactagtatgtaggaatctgtaaacagacatacttttctttatttgccattgctgctagaaccactttctttcctattgttatttttgtgtacctttccaggagttgaacttagtaagttagtagtatgaatttaaaatgcaattcagagaaaaaggatatttttttatgtggagtgttaactttttagaattctgtggttattttatcttgattttagacttttgatacaacaacagattttgagttaagttggtgcgtttaatgaatagcttttgaatggattgtagtgagtttgttttttgtgtaatatatcttaaaatcatctagtggtttttattttaaaaataactcaatgaggttgggtgtagtggtggctcatgcctgtaattccagcactttgggagacaaggtgggaggatcacttgagcccaggagttcaagatcagcctggacagtatagtgggccactgtctctacaaaaaataagaaaaattaacaggtgtgttggtgcatgactgtagtcccagctacttgggaggctgagatgggaggatcccttaggcctgggaggttgaggttgcagtgagctgtggtcacacagctgcactgcagcctgggcaacagagcaagaccctggatcaaaaaaaaaaaaaatcactcaatgaaacttacttttttttttttattgattccttaacagcactattccaggcatacagaaaatttggatacgaacatggggttgttctcataataattcagatggagaatatatggctggacagctagctgcttatggctataaaattacaggtaatgagatctataatatattttattgattaaatttttcagaattaagcttttagagataaatagcctagcagttaaagggtattttagcatgacagtgattttaaggtgaaacagatagttattacacattttgtagataaccatggatgtcatatttaaaaaaactttttattttgaaataagtttagactttcagaaaagtagtaaaattagagagttcacatatgcccatcaccaagcttcccttgatattaacatcttacgtagttgtaatatcattaataaaccaggaaattaacattagtgcatttctgttatctaaactgtagatcgtatttgaattttaccagttttcccattaacttcctttttctgtcccaagatctaatgttgggtcccaccttacatttagtttcatgtccccttagtttcctccaatctgtgacagtttcttaattttttcttgtcttctgtgaccttgacacttctgaagaaaacatttccttgatatttctgatgaaaatgattattatgtagaatgtccttcaacttgaattggtctttttctcatgattagaatgaggttctgggtttttggcaagcagagaacagaagcgatactatatttttctcagtgcgtcatatcggggtcatgatgtcagtgtgtcttatactggtacactaacccatgtctgctaggtttctttccaatacagtcactgtttttctcattacaactaataaacatcctatttctcctcaacctttggcctgttaattttagtatctactggtggatcttgtctgcaacagttattactgtggtgtttacttaatggtgattttctgctatcttgttttctttacatttatatttatttatttatttatttatttatttatttatttatttactttgagatggggtctctttgtgccccattctggagtgcagtggcacgatctcagctcactgcatcctctgcctcccaggttcaagcgattcttctgcctcagcctcccaagtagctaggattacaggcatatgccaccatgcctggctaacttttgtatttttagtagatacggggtttcaccatgttggccaggctagtctcgaactcctcagctcaagtgatccactcgcctcggcctcccaaagtgcggggattacaggtgtgagccactgcgcccagcctcctctttacatttattaattggagtttttctctaaggaagagctgtccattcttctccatcttaattaattaattaaattttttttttttagacagagtctcgctttgttgcccaggctggagtacagtgttgtgatctcggctcactgcaacctctgcctccggggttcaagggattctcctgcctcagcctcccaagtagctgggattacaggcatgcgccaccacaccaggctaattttttgtattttttagagatggggtttcgccatggtagccaggctggtctagacctcttgatctcaggtgatttacctgccttggcctcccaaagtgctgggattacaggcatgagccactgcacctggcccgtcttagttatttctatcagtacagactcatggatatttattttatcctgtggatatagtctgatactatcattatgtattatgctgcttgttgttccaatcttggccattaggatcttgttcaggctggctcctgtgtcttttcagcatgccggcatcttttttttgagcacttctttatttcctggcaccacaaaatgttctaatctctcatattttcccttccccagtcttggaagcaaccagttttccaaggagtcctgatttttttcattaagagaatggcatttagaaaaggggatctgggcagtcaatatgcttgctcgttgccaccgtgaggtgtcgctgttgtgaggtcctcttgggggatggagctaggaattatgtatgaatagtaacccacacatatgcacgcatctgtagctatttctgtatctattatgtgtactaaatggaactataattcgaatgctttgtgacaggcactgacccggtgctttatgtatgttatcttgcttagtccttgagtaggaggaaatattggcacccctactttacagttgagaaaggagaggttgtgtcttttttttttttttttttttttttgagacagagtcttgctctgtctcccaggctggagtgcagtggcgcgatcttggcccacagcaagctccgcctcacggttcaagggattctcctggctcagcctcccgagtagctgggacttcaggtgcccgccaccatgcctggctaatttttcatatttttagtagagacagagtttcaccgtgttagccaggatggtctcaatctcctgacctcgtgatccactcgccttggcctcccaaagtgctgggattacaggcgtgagccactgtgctcggcctgagaggttgcgtcttatcttaaatcacatatgcagtgaagtcctttgtcacttccaaacactgctcctgaccattgttctgtacctcatggctgcctttgcatgtgtaattggcaagtcctagctataagacagcatgtaatgattaaggaggattggaaacctagtccttgtatcaccctttttccttcagtaactaaaatatctttttttttttttttgagacggagtctcgctctgtcacccaggctggagtgtagtggtgcaatctcagctcactgcaagctccgcctcctgggttcatgtcgttctcctgcctcagcctctcgagtagctgggactacaggtgcccaccaccatgcctggctaatttttttgtatttttttagtagagacggggtttcaccgtgttagccaggatggtctcgatcccttgacctcgtgatccacccgcctcggcctccccaagtgctaggattacaggtgtgagccaccgcgcctggcctaaaataccttatgttattaattttgtattttttataacatattctttagatggcaaaatgagtcttaatatttctgtcctttaagttaaaaatggtcaaaatatgctttcagaattacttctctatattcattagtaatttttagtataatttagcctgggcttgccttaccatattctgatggtgtagtttgagtattaagaaaatagaatttatttattgatttatatttatttatttttgagacaggtctcactatgtttgcccaggctggccccaagctcctgggctcaagtggtccttctacctcagcctcccaagtagctgggactacagttgtgtgcctggctaagaaaataccctaaggaaaaaaaaaaaaaaaaggctgggtgtgttggctcatgcctgctgtaatcccagcactttggaggccgaggtgagagagggtgggagggtcgcttgagcccagtagtttgagaccagtgttggcaacatagtgagaccctggccctgcaaaaatatttaaaaagtagccaggtgtgttggtctttgcctgtagtcccagttacttgagaggatgaggtggcaggatcgcttgagcctgagaggtagaggctgcagtgagctgttctgtgcacagcacttcagcctgggcaacagagtgagatcctatctcaaaaaaaaaaaggccctgagataatttcctaaaacataaggaaaatcagatattgactttttctatgtcatattaaatatctaatacattttaattaaattttaatccattagcagtttgtgtttggtcttgtaacagtacttgtctgtataaaataacagtcctggtatgtttatacaagaatattaggttttgttttacacacctaattttgtttcttatttgggaatagttaaaaagagaaaataaggaagtaattacttgaatgggaattttttttttttttttgctaatgtagcatagtctgttgcttttatatattatatgtatttgtattaattttataaactattgattgttcctactttagaaattcatagttgttaattccagcctggcttgcatgcagcagactgtgggaatactttcttcactagtctaggtgctataggcccaggaaatataaacagaattagctttgataagacatttaagaagtaaatctctacagattttatatttaaagatttgatatgaatgacttctggattacctatgccagtagtcactttcattactatggaataatgagaatgtataaagtttattatggcttactagttgataatgttttcgttaatcaaatggaaacctaaaatattaaatgtataacataaaataggtataaaatataccttatgtataatgtatagggagtttattgaaaacagtatgcagataaattatatcaaaattagttctcagtagtcatagatatttttatcatttggggaagaaagattatgtgggtatgtatttgaaattgctgcttttaaatatgcaaattcaggatataattattctgtgttaatacttcataaggccaggtgtggtggctcacgcccgtaatcccagcacttaggaggccgaggtgggcagatcacctgagatcaggagtttgagaccagcctggccaatgtggcaaaaccccgtctctactaaaaatacaaaaattagccaggtgtggtggcacacacctgtaatcccagctactcgggaggctgaggcaggaggattgcttgaacccaggaggcggaggttgctgtgagctgagattgccccactgcattccagcctgggtgacagagtgagacactgtctcaaaaaaacaaacaaaaacaacagcttcataaagcgaactgtcagagcagtttgctgttgttcattgcctcttttcaaacccttttttattttgaagaaaaaggtggctcataacttttttgttacgtagtctcactccgctgcccaggctggagtgcagtagcaccatctcggcttactgcaacctctgccttctgggttcaaatgattctcctgcctcggcctccggagtagctgggattaccggtgtgcgataccatgcctgactgattcttgtatttttagtagcgatgggggttttgccatgttggccagactggtctctaactcctggcctcaagcggtctgcccaccttggcctcccaaagcgctgggattacaggcatgagccaccgtgctcggccagcttttaaatgattctcctgcctcagcctcctgagtagctgggattacaggtgtgcggtaccatgcctgactaatttttgtatttttagtaacgatggggttttgccatgttggccagactggtctaactcctggcctcaagtggtctgcccgccttggcctcccaaagtgctgggattacaggcatgagccactgtgtttggccaacttttaaataaactattacaaaatcgtgcctgcttgtctctcattcaaagaataaaacttactgaggagaaatgatgttagcccctaaaactcagaacaattacttgtatcgtgggtacatggatatgtgatataattagattagtatcttgggaagcaattaaactttccctgtgagcaccatggctttttaaagaaatgaatgtgttctccaagtaggcaatttttatagattaaactttttttccagtcatcctttgtttattgtttttggattatttctttgggagatgttggtaaattgttttcagtgtgctcattggtggcaaatcttcatatcttgagaatacatttagtattagaaaatggccacaggtcatttgaggccaaatctggtgaataaaatatgtgctatgatgttgcacaatgctgttctagttgagaataaattttgtcttaagtgattctgaaatcagttcttaaagagttctgaaagagtagctgtgattcttacacgtttttggtctcttcagaacctcacaatccttacacaattttgttaaggaattcgtaaccactccctagcctgatagtggaataaaggtttaggcttccaaggtgactgctttgggaacagccctcatttagatacagctgtgttagatacagctgtgttatgtttagtttgcagccatgcctggtgtgaatgaatattgtatgtgttttttggttagttggaaaaaaaagtccatccaaagaccattgactgaggctgtggttcataaacactgaagagtaatggtgttatgtgtacgaaatatttgtggacatgcttacctaagtcagaatagagtgtttagcctgggtgcccacattttcagagcagttatttaaaaattgctgagctgttaacattcttgatagtttctttgtatatgtgtttatagtttattcatttggcaaacattctctgaacatgatatatgttacagagtagagtgctaaagaggtgtaaagatatgaaattgaaccagccatggattccagcagacaagaagtttattcttttttggcaaaggaaaggccttcatattctgtgttaaatcctagaagttgttttaggaaatacttaagctcataatgtattctttcactttttgtaatatgggaggtaggacctgctttatttttttatttttatttatttttattattttccgagatggagtcttgctctgttgcccaggctggagtgcagtggcacgatctgggcttactgtatcctccgcctcctgagttcaagcaattctcctgcctcagcctcctgagtagctgggattacaggcatgcaccaccacgctcagctaatttttgaatttttagtggagacggggtttcaccttgttggtcaggctggtctcaaactccttacctagtgatctacccatcttggcctcccaaagtgctgggattacaggtgtgagccactgtgcccagccagagttgtttttttttttttttgagacggagtcctgctcttttgcccaggccagagtgcagtggcgctatcttagctcgctgcaagctccgccttccaggttcacaccattctcctgcctcagcctcccgagtagctgggactacaggcacccgccaccacgcccggctaattttttgtatttttagtagagacggggtttcactgtgttagccaggatggtctcgatctcttgacctcgtgatccgcccgcctcggcctcccaaagtgctgggattacaggcatgagccactgcgcccggccccagccagagttttaaaatatgtaacccttattagaagcctttctcgtttttttttggtggaaagaagggggtatatatcccactgcagtctataccacaggaacatggtcagtctgttaatttcagtgctgagttgggatttgaaagtaagctgtttcttggccgggtgcgatcgctgtcgcctgtaatccctgcactttgggcggcctaggcaggtggatctcctgaggtcaggagttcgagaccagcctggccaacatggtgaagccccgtctttactaaaaatacaaaaattagcctggtatgatagtgcatgcctgtaatcccagctactaggaaggccgaggcaggagaatagcttgaacctggagggcagaggctgcagtgagctgagattgtggcactgcactccagcttgggtaacaagactgaaactccgcctcaaaaaaaaaaagtaagctgtttcttcagttatagatagcagtgtcagcagagtgctacctggtccattcctacctccttaatcataagtataaagtaattgatccagtggaacctcaataggatatttttggaaattctagtggattcaatgaaagaatcatcaactatcttagtatagggctgttaacttatactttctacacataactctttaatctagctttcttgctcctttactatcaccatgattatttacatttatatagtgtcttacagtttgtaacatacatttagctctgctaattttgtatagcttgtacctgaagataaaggaaaaacaaaatgttaacttaggccttacagaaattatttaaaaacatcctgacataggccaggtgtggtgactcacacctgtaatcccagcactttgggaggctgaggcgggcagatcatgaggtcaggagatcgaggccatcctggctaacacggtgaaatcctgtctctactaaaagtacaaaaaaattagccgggcatggtggtgggcgcctgtagtcccacctactcgggaggctgaggcaggagaatggcgtgaacctgggaggcggagcttgcagtgagctgagatcatgccactgtactccagcctgggcaacagaaagaacgagtctccatctcaaaaaaaaaaaataaataaataaataaataaataaataaataaatgaaaaataaataaatacataaataaataaaaatcctgacattaaggtttctgacttaaaattatatgtgtaagtaataagtatttacagtgaagtgtttagttatatattgaatagaacttttaaaaaatgtaacccagggttttcttgccaaaattctttattctgtagccaaagatgatgtctgttgttaatatcttaaggttctgaagtctacctggaattatagtgcaagtaaattgtagtctgatcatgtgtagtatctgtaatgcaaggtgtgaccatcagcttatagatatagttgaatcttagcattattctaaggcttggaagttaaacatagaattatatacagagaaacaaagcctttcatacattaaaatagaaactatttctgctgatctgtaaaatgtccttcttgtggatattttcagataattttccaagcttttactatatatatgtatacatatgtatatatatgtgaatacatatatatgttttatgtactgcaaaactgtagtctcaagatcattatttaaaagtacatccttaacatggctgggcacggtggctcatgcctctaatcccagcactttgggaggctgaggcaggaggatcgcctgaggtcaggagtttgagaccagcctggccaacatggtgaaaccccatctctactagaaatacaaaaattagcccagcgtggtggtgcatgcctgtaattccagctactcaggaggttgaggcatgagaattgcttgaacctgggaggcggaggttccagtgagcggtgatcacaccactgcactccagcttgggtgacagagtgagtgagactccgtcttaaacaaacaaacaaacaaacacatcaaacaaacaaacatccttaacttgccagtaattcactcttacttttcttcctgtggaaatgtgcttatgttaggttatttgcatgaactgagattattaagttctaatatttttctgcacattttggccactattatttcatgtagaaagttgagagaattttattcaaagctgcctttgtgtgaggatctgatagcatagaggtagtagaaatagacattttttaaggggtaactcccaacaaaataaaagcgaagtaccagttgtggcagggatgacagtggttattggatcaccgagctgtattctttctatcagctctctccaagggactcagctttctaggagggggagatggaaatcttaaacaggtttgatagcttccctaccttttatctgcccagacaacaaaaataaaacagctcacagtgttaggatttggggtgataaattaatttggagatatctaaatgtaaaatgagatttctgggcacatggcagtgcggtctgtatgataaacaactggggttgaaacagtaagtgcatgaactagacagactctttttgaccagaccttgtgttataggtgaatgaaatttgggaatcctatacttggaattctggaatggctagcctgggccaggaaaaatcactttgtaatctaagaaggaattgagttaagaagatttgttcatcacaccacatttccatgttgttgaggaaaatagattggcagtggtgacaaggtcaaggatgtgttgttcgaagttgtagaagataagcagcaatttaaaggcgttacaatacatttttaagagtggaaattgcattgaagagtggaagaaaagtcgacataagagaattagggcatgttgtttgcccaggctggtcttgaactcctgagctcaaccaatccacctgcctcggcctcccaaagtgctgggattacaggcgtgagccaccgtggctggcccttaatatgttttaaaaggatgtttaatactcttcattactgtgttatgcaatagttgcatgatgatttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaatatttttcttatgtttgagagttaacatgtatggttgattagaatcttcaccttctaaagggattaaggaaaaacctcgttcactgttgtgaattctaaaatgttttggttccaagtcctagtttttcttaccctggtattatgtccaaaatgaatgcccactaaaagttagtaactctcatggcaattaaagtattttgataatgtttataagttcttgttctcaattttgccactagtaaagatgtgggagaagttaatctttttttgttgtctttcttgtgaacttaaagatcatttttcatcctgttcaacctttggcctgaccttttcaggtcactaaatgtctggtttgcacttcttgtagcatgtgagaaataatacttcaaaattcaagtgtaattgtattaatttttgtgaataaactgctatggagtgctgaagtgtgttaagatgcctagtcttttcagaattaccggcattatggtattgaacttaaaatattttatgtttataatattttagaattttcatgagtcagataaacatatacccagattttcagaaacttgacatttgcttaattgcttaataattcacatcaggcttagagatttgtgaaatatttttgggataatttatttagaaatagcgtgtgtttaaatattaattttcttttttaagaaaatgggcagatgataaattaccatgaaagcttcatttaaaaatctgttgttagtattgtcttctttaattttggggagaaaaaacttctgagatgttaacaattgaacatgtagtgttggctctttttggccttcaatttaaaattgtcatgtgtttggattaaagacatgatgtatttttagctattgggcaagagatggcaatattgcattacatgatcactgcagttacactattataaatgaaagtgaatttcatgttacaaatgttcttctaatgcaattattaggcgtcattaaattagtttacactttatttcttctgattgattttttaaaaaactttttagcagtatttatataaaaattggacaaattgaccctttcagaggcagtatgaccctttcagaggcagtatgatcttgtgcagatacccgtctgcaatatgtgtgctgaacagatgtgaaaattatttagtcactggcttactgcttgacaccttcattgctctgttgccctgactgtgcttgtcctagaatctggttgttgtcctctttgtccataggagcatatgaaggtgggagtttttgaatttgaggacaaacatttgttacctttaatactacattgctttcatactcactaaaaactaacctttgcatagtatgcaacttgtatagcttattaatcttcaagtctattaacatataatatggttaaagaggcttaataataaaacagaatgtagtaaactactgcatttaaaaatttcccaccaattcctactttaccagcatatgtttgatggttaagggggaagtgatttgaatatctcaggatttgcagagactttgcttttacctcttctttcattgtagcttggtcattctcaaatttgagtttctaaggacttttaaagtgttacgtatgctaatccatgtatacattatttttatgattgattaaggacttttttgggaagagttgtggctatacatgatttttacctaatctaatcattttagattcaaactccttgcataaaatgtagctctgcttagcactgctgccattagcttatttctgctggcttagagtgacgtctcggctagttcctgtgttaagataatttaactggtttacattttcttttttatgatgtgtgagttctttctgtctttctcatctttacctttgacatgtcagagacactgttgcttagttattaagaacagactgtcagccgggcgcagtggctcatgcttgtaatcccagcactttgggagcccgagaggggcggatcacctgaggtcaggagttcgagaccagcctggccaacatggcgaaaccccatctctactaaaaataaaaaaattagctgggcttggtggtgcgtgcctgtaattccagctactgaggaggctgaggcatgagaatcgcttgaacccaggaagtggagattgcagtgagctgagatcacaacactgcactccagcctgggcgacagagcaagaccatctcaaaaaagaaaaaaaaaaaaaaaaaaaaaaaaagaacagactgtagccagctcttaatattaagccagactgtaaaaccaactaccaccatttattagctatataactttgataatatctctgtgtcttagcatccttattaaatgaagatggcagtggtagtcctttctgaagattaaatgaatcagtatatgtaaagtggtcaactttgtattttagtattataataattattagatatgatacctggcacaaagtagtaattcaggtgtttttttgtgtgcattagtgaacaagtaaaaacaagtatatttcttgaatataatgtatagaagtaattttattctttttatctttaagttagaagaaaaattaaagtatattccaaaggttagataaatgcagtgtgtatgggaatcccttgagtttttcagtaaaattctatttgggtggctgtcaagtccagtctgcatagtcttgacatgtcttggataagatccttatactatcacttttcctgtcatggacactacaaattatattgaatcagaaatctaatttaatccattcttattcaattggaagcagtaattgctttcaatttaatgggattggattcagtattagaaattttgatgttccttcaaacttaatacagtatggttatatatatttccatttatttgtgtgtgttcctgtgccctcgcagagagattatcttggagtattacttgtattcacttgagttatttgcaacggttggtaaagaggcatattgtaagggtgggaatgagagtggcattctctttgttttttttcttttctacccatggaataatgaagagagaaataataagggccttcaaaatgggatttccatccactcagaaataaggaaaggaaatttagagtctctggagaagatctggaatgctatttactcttgagggtagacagcatccagccctactaaagatgaaaaaaggagagcctggggatgaaattaaatccatcaaaaaattcactgttggtcaggcctggtggctcacgcctgtaatcccaggctgaggtgggcggatcacttgaggttaggagttccagaagagcctgaccaacatggtgaaacctcgtccctactgaaaatacaaaaaaaattaatcggctatggtggtgggcgcctgtaatcccagctactcgggaggctgaggcagaagaattgctttgacctggaaggtggaggctgcagtgagccaagatcatgccactacactccagcctgggcaatagagtgagactccatcttaaaaaaaaaaaaaaattcattgttagcatgttatttcaatctttcccggcaaatcatacttagagacagctaagtttatcaattctcatgtcctatacggtgctttttcttgaatatacggtagacaagaggtaaggcctaatgggtgaagtaactacatttctgagttagtgtctaattgtttttgatcacctagttccatttgacagaagatgtagtgcttatggctcatcccattgactctttctctgctttcactccttcagcagtgttttcagtagcctttttggtgatcttattgacttgtcttttttctgatgttctttttaattgaattgctatatgatataagatggaatgattgtgttttaaccatgatcttcaagtctgctgtgtaaagaactaatgattgcagtttgagtaaaattcttagtaacaagtgaatcaaagataaagatagatcattgagaatattttttttctctccatgaggaagttcattattagctagcttacaaaaatgaaggaattgtgagagtgttctggaataaatgttatggcttaataaaactattcagaaaatcactgaacaatacaaaagtggaagacattgaaaatggtatatggacacatctaagatcaaaattaagccagagaagctttagggagagtatttgaagcttatcatttccatttgtaacggctttttatattgtggtgtaaaatcatgtgcaagccataaacaagggcttttaaaaatatttttgttaatttttttttagttttatagagatggtgtctcactgtgttgcccagtctggtcttgaactcctgacctcaactgatcctcccatctcaaattccctagtcactgggattacaggcatgagccaccacacctagccaacgagggctttttttttttctcattaacatagagatatgaagaatactatattggattaaaagtttttgcatttgtgaagtgtaagcagctgtgtgaatgtagtcaatgtgtattcttcatttaataaacataagtatcttttcctttccaaattatacaaaaaatactaaaagcaatcaaacgatttttacagaatcttaactaatataaaaatttgttcattgcttataatacagaataattatataacttggctcattatctaagcttaatgaattaatgttggaatgtaaaaacgagcaattttaagccagcgatggctcaatcatttttaactgagggattttgggatcaattactaaaatgttctgagcctcagtgtctttaaaatgtaatgatgctctattaatctcatgaaattgaagtgaaaacaaatgtgaggtaatatgtttttggaaatatttataagtttaaaaatagcctgcttggtacttgtgcctgtaatgctagctactcaggaggctgagacaggtgaattacctgaggccaggaatttgagtctgtcctgtgcaacatagcaagaccccatctccaaaaaagctaatatatttataaagcttaaatgttataaaatgataaactgatggtttttgaattctttgctctactcacctttcatctgttaaagatgtttttgtacaatttagctcagttcctaaatataccaaaagatggcactgtttacctatgtttaatattttaatttgcattttttgatgaaaaagtgtgttgaatgttttatctacaaatgttttaaattgaggttatttttttacatttaattttctgttttgtaaatggatctttaattcatgtaaagtttactaggaccaggtttcatttttattttgaaatggtttggaaattcagatatttaacaatcattttgtagatataaactcctgtgtgatccattgtaattaatgataaaaccttgtattaatgtgacagctaatgtttcatggaaaacctagttgcttttgtataacaaaaaccattaaattttttaagcctctgaaaacagtccagtgattaaaacatgacagccacaaataaattatttatgtggcttttaggtcacactgcccaggtttattcattttagaaagttattttatcttaaaagtacctttgaaaatgtagcaaaacctttcattgcttgaatttcctactcacagttgtgtgatgagaggagaatctaggtccaggtcctgcgaagagcttctctgggtgagaaatgcaaaaattagataatatgaatttgacttgaagtgagggttatttatatagcaggatgtggtgaatacacttcccatacagttagacggaaacctcctgattgttcatttatacagcctattacatccaatgtagtttatgacctagaaagagaatacaagtaggatatttttttatcccatcaaagctatctatatatatatatatttttaaatgaacagcatttgtcagtgatttttacaggggtgaaaaagcacaagacagttccattactattataaaatgttttacttttgttgtgggggtaagtttagaagtccaagatataataatttcagatgtgcttctactgtttcctttacttaaaagtagggactattttgaggcaatataatttgtatgtttcagtttttatttctctctgaaaatcactttttagggtaccatgccttggaaagaaagtttacatttttttccgttaaaaacccatcctcctaactctgaaatgactgtctcagttactaaatgtatatagcttgggggaagtgaaggcacagttggcagttagaggtttgtttttatgttcatgggagtatatgtgcttatatttaaatgttcactcttctagcagggtttgttgatgttagtaatatgctacatatgcgatttgtctgaattgtttaaaaatgcataattacaggaggatttgattattcagcaacagttccagtagctaaagactatcatatagatattttcttccagtatttgacagtggttctgtgagctatgagtagcataaaaaataaaaagaagatactgtgactctttaataccctagaggccgtagtcttaggatattcttactgtagagatgaaaaaacagggcttcattaacaaactgaactgctatttcacctcttttagtagatgtgtaattctgtgggtttggtaaataacaaaggcttttttcctaaatgatttaatgctttcagatttttgtgggaaaattagaaaaagcaaaaatgcactcagtgattttttttttaaacccctttgtttctggacaaatggacaaagatagttaagtgtcccaaaaatggttttaacaggcttccctctacaaccccatacataccctggctgtccataattccaattttgggtaggtagtaaaatgtgatattagactacgagtattttccctccaaataatacttgtgattaaaagaaatgcaatcaaatagcattatatattcgttatgaaagaaagatctgtcatgcagattttgcctggttcctttagatgccttgtaataatgtgctaatttatgctgatgatcttgcctcatgacccttctgtgtggcctagatatgttaatatgttatagctttttaatttcgatcctctgtgttggttgaatatgcttgttagtccatagtgccactcactagtctgtgtcaagaactgaaaaagaacaagaaaaatgtatctcagaatcaatttctttaagcatgtatcagtaatggaggaaattataaaatatacataattttaataggactttatgtctgaacattcattgaaaatagtaagcactctaagtactgtaagcttttaattaggaaagagagttgggtcattggttttattaagcaagggcttattaacatcttttgattttttttcttgatttttgtttaatatcagtgagaaaatattacaagaatgaaaactagacatcactggcagtttttactttattgcatccatttttctgttccctaaaccttgagggttatgcatctaaagattcccatggtaggaaaatactgtatgtggttcataaattcatgaccttaaggtagcagagaccaaggcctaaaatagatgggagaactcaactgtttaaaaaaatttgttaaaataaaaattccatagaaggaaaacaatttatgtaccttaaatataattcatctttattatctttcctcatctacagaagcttctccttattacttatttgtgttctttctacagagaatatactaggaggggtatttttccttatttttagctcttgatctgaaagtgtaatgttcttttcgctttgtcttgaaattgttgcctccccatttttgggtctcatctggatctgaaagacattgactgactcaaatatccgaaaaacttggtaactttcaaattggtatacgtggcataattaagaatatgttggtgcaaaagtaatcgtggtctttgccattgaaagtaatggcaaagaccacgattacttttgcaccagcctgtatttcacaaacgtctctgtgcctgtgattacttctctctaaaatggtttatggagtagttgttatgattaataaatggttgataaatactagctattatggtattaagcattaataaggaaaattcactattacatgtaaatgttttgagtccctgaaattaactggcaacttaatgaaatttgatttaagcacacatttagtccatttcaatctatttaaacgtgtttctctcttgcacatctttttctgatggagagcgtgagttaggaaatgagccaaaataggatatataatggatagcctcttttggtagccagtcagacagaatggggtgatgtcttcatagaaggaatatggaattaggagttggaagatttggggtcttgctccaaagatcactttgattgttggtgaacttatttatctagtctcagctttttaattaattaattaattaattattttaatttagagacgaggttttactttgtggcccaggctggagtgcagtggcatgatcatagctcactgctactttgaattcccaggctcaagagatcctcctgcctcagcctcctgagtagctgggactacaggtgtgcaccaccatgcccagcaaatttttttttttttgagacggagtctccctctgtcgcccaggctggagtgcagtggcgcgatctcggctcactgcaagctcctcctcccgggttcacgccattctctcacctcagcctcctaagtagctgggaccacaggcgcctgccaccacgcccggctaatttttttgtacttttagtagagacgggggtttcaccgtggtggccaggatggtctccgtctcctgacctcgtgatccgcctgcctctgcctcccaaagcgctgggattacaggcgtgagccaccgtgcccagcacccagctaatttttaaattttttgtagagacggagtcttgccattttgcccaggctctcctccaactcctggcctcaagggatcctcccacttcagcctcctaaagtgttgggattccaggcgtaagccactgtgcctggcctattcttagcttttaaattctcgtctatgaaataacgcatttgactgttccaaaagtgtgggggacaggtcatcttctttcacatgcattgtcttactttgtaaggtaaataaagtactatattaagaaatgtgggcctggcacggtggctcacgcctgtaatcccagcactttgggaggccgaggcgggcggatcagaggtcaggagattgagaccatcctggctaacacggtaaaaccccgtctctactaacaatacaaaaaaaattagccgggcgtggtggcgggcgcctgtagtcccagctgcttggaaggctgaggcaggagaatggcgtgaacctgggaggcggagcttgcagtgagccgagatcgcgccactgcactccagcctgggcgacagagcgagactccgcctcaaaaaaaaaaaaaaaacaaaaaaacaaaaaaacaaagaaatgtgaggtgtgaaatccttcttgaacatttttaacttcactcctccctatgctgccactctgccccctcatcagactcttccttaacacactgctgtgacccagattgtctttatttcttcttgtagcacttgttagactctattgcaattatttatgtatttgtctcattagactgatcttgagtacagagatggccctttattcttgtattcaaagtacctaccaccatatttggcttataataagcctcagtgtttgttgaatgaatttatatcaatatccatgccattcatgagaaacaaaacttattatatagagcatagaggtggtttctaattcgtgttgctcttatttttactgttagatgtaaaacgttgaatgatttgttaccacttggcataattaaatttagcatttttctagtttaagtagttcagtttttgagacacttttatgagcctcactatattaatggccttattggtgctttacagattttgtgattcatgggcactgtaagtataaatttcatgcttacagcaattgaataaaataggcacattgttctttgttagtttcttcagttggttcttttaattttcctgttcttactggtgattccttgaggcatctggccagtgttgagtatttcttcctgactcatcatcccttctgccacctgccaaaggaatgcttttactttggtcaagagcatttcgagtgagttagatttcattattggtgtaggctatggaccacctgataagtctaagcatgtcatactaattagcattgactgccagccaccataatgcttaattcaggtgctatgctgttttaattctaaaggtgttgtgaagtatggaaaaatcctttacctgaatatgaaactagctactaaatttggagttctctccctacccctgcagcattttcctttgtgtgaaatttcagttgattatattcaatttacttttatatagtctttcagaatcagtagaatttttttccttagatatatctaagtcactcctttttgagatgatttagaaaagaggaaattgaggattggaagttaaaaagggagaaagatggctggtaggtaacatgtagaagttttaacctttcatctcaagagagtgattcttctgggctttaatacgtgtatctgagagctgggaggaagctgtgttggagggtgtctgggacctggtgagacctcagaaaataagagtccatcataaagtaagaaaggcattgatgggacttaaaaatatttgactacagcgaaagctttttatttatttatttatttttatttttaattaattaatttttgttgttgttgttgagacggagtctctgtcgccagggtggagtgcagtggcatgatctcggttcactgcaacctctgcctcttgggttcaagcgattctcctgcctcagcctcccgagtagctgggactacaggcgtatgacaccacgcccagctaatttttgtatttttagtagagacggagtttcaccatgttggccagtatggtctctatctcttgaccccatgatccatccacctcggcctcccaaagtgctgggattacaggggtgagccactgtgccctgccaattaatttatttttttgagacgaagtctcactctgtcgcctaggctggagtgcagtggcgtgatctcagctcactgcaacccccgcctcctgggttcaagcgattctcttgccttggcctcccgagtagctaggactacaggcatctgccaccactgccagctaatttttgaatttttagtagagacagagtttcactgtgttggccaggctggtctcaaattcctgacctcaggtgattcaactgccttggcttcccaaagtgctgggattacaggtgtgcactgggtcagctttttagaatgcattttatctgctgcaagttaaaagaaatttactagcctttgaatgaaactgtagaaggaaaatcctgaattcctagatatcaagggatggttagagaacccccaaaagtgccgtattgatcattacaaaaaaaagggtaaaatgtacccttatagtctcttcatttagtgcaatatctttattgtggtaagttatagattattgataggggcttctatagtttatttttctacttttggtctccttatcctatcttcccactagattaaaaaattctccccaaatatattctgctgtggggattttcagaaatgttagcaccctcactggggaggaattaccttctacctgtatttctggaaggggaagcttatgtgaatctctaaaaagagaattatattgatgttacgaagtaagtactataggtgaaagagagaataagaaaaaactcgatgtttaaaggagcatctattgagttactctgtgcaaggctgaccaactcaccttgtgatcttagtcaagccatgtaatctccctgagcctcagtttattcatatataaaataagcaagttgaactcctctgttccctggttctttgtaaattcattcattcttagatattcatcataagcctgttgtgttatgtattcagcagttgaacaagacagatgcagtcttatccttgtaagaagacttctctttcccctatctctgctgacctgtccttctccctgttctcttatctagtaattggttggataatgaggaagtgaagcaatgtgaaatgcttaattacaaatttggggactctgtctgcttttatggatgaagtggattgacattttggggggaaaagtaccctgtaaaaacatagtttatatatattaaaaatgttattaaaatgaaaaagtgatttatcagttagtggtaaattaattggctgacttgggagtgaaaattatttgacttgggagacaaaattactctctagactgagctagagagtaattttgtctaaattgaggtatagcagatataaaatggaaaagatttatctttgatgttgagtaattttaaaaaatgcatttgagcttcttgggaatagttacccatcttgatgtatttgctgaagatcagatgtaattttaaaaaaaatttttggtagaaaaatgtctttggtataagtcaggcctattatcttgagatttatgcctttattctggaaaattgaaatttttatctcataaaagaggaaaataatttgaatggagttaataaaaatgaaaggagtaaaatttcacttagaaatacagtgaggcatccaaaatgaagaaaaatcccttatttggcttctagatctaaaatgatattctaatctatgcaggttggttcaagagcactttacccctgttggaggcagccaggttagctttattgaatgtaaatctctgacttctcccaagatacccatgaaagcaactaaattcattggttattaggcagcaagagtaagttcaattttctctacacttgtgacaattagaggttggttctagcctgtctaatgcttaagtttcaaggctacctgtatttgagagctgttttggggagataaccttgtaacacatacattttaatgagtacattacttttaccacctgctgaagtcgacttggagtgactactgacctgaagtgaatgcctgtgttcaatattaatatggcatgtctggatccagacagcaatctttcattttgacatgcacatagtcaaagtaaattaatgtttaaaacccaaacactttaagttcagccagtgtgtgcattccataataatccttcagaagcagtttacatagaaatgctgagtgctttcttatactttatttatcatatgtattgggtccacattgcagtacttataacgagatttatccagtgctgtttttgttccttgttttgtggaggctaaagaagttaatttatttcaggatttagtctctgcatattttaagcaaaattatacttaaaaatcttcatgtgcctggcaagatagtagtctaatttcagttatattatttttagatggaaaaaaaaaatcaagctaattgcatactttatttctgctcaaatgatcaccaatttttgaaagtatagtagtagtttaaaaaaagaaaaaaactaggcccagatatagtgtatgtttgtgactacatgtaacaaggatattgctgattttccttttctctcatacataccattttctagtcttgcttttattggttagaaaacattcatggcagatgtagtaatggggaaattatattaacatttaagtattaaattagcttgtagccagagtctccttctaatatgatgacatttagcaagttcaggattttaaggaccatgttgcgcaactcattgttacacatttcctgtttgccttttttgaaaaagtatctgagatctgttttttcagattggaaatttccattgtggatttcaatgttgttgttgtcattttaccttgctggtcagtgtttgttatttatgtattaagaatatgtagtatagtgaccataatgagaatagtaggtgattggagttgtatgcaaatgacagttttcataacacttttgcagtttaatttcaacaaaaacctcaagttatatttattagcaaacatatttcagctaaggagttttttatgctccaaaaagatggcagatggaaatgaacctaatatgtgttcaaagaaagtatgctgcatttatttcaaattgtatctgatacatcagcatgatgatttatatgttgtcttagaattaaagtagatgccatacttttactgtaaaagtcaaaattagatttcttctatatttgacagaatttattttctgttcataaataaatatagtatttggtttaggatgtagaacatcaaataacaactgttagattatgcttaatatatttatcattttctgaattttggatgttcttaacatcagaaaaatatgtcctttacccatacagtgactttagattggatttggaagcattgtacagagaagacctattgttcctattgaataaggatgccgtacagagatgagctttttgacccactgctcttccagtagtaatggatttgcactaatttgagcagagtatgccacttggtcctgtttttcagttgtcctgtgtgatggctggctagcaaaatcaaacatctgcattttgactgtggaaggcagtataactagctggctcatactggttcaaatttgcaacactgatatggttagtattatggtgtcactacctgaattaagtagttgtggctaaattgtttatattatatgaacatattcgttattattctgcatggagaatttttgtcctcatggattgtttcataaagtgttttattagcttggattaattggaaaataagctttttaatatggacctctcccctagtcagagactttgcaaatgatttctacaaaaataaactataaaatagatgatataatggggcctattattcctgatttgattttaatttgcttccttttataatttttccacaataaaacagagcctctcagaaagtaaaaggatgtaatcctagctcagatggtatagggtccttatgtcttgagctattatgatggaaggtacccctatacctccactgatagaaatatgatgggcagacattttctttggtgaaaagtagttcatagtttactgtgatatccactccttggacttactttagaggactgtttactgagggcaaaatatgtgcatgattacatataatcaaggttaatttttatcaagggtcaccatgtttttgctatggtctgacaatcatgacctacattaaaagagccctgtgggtctgtctggtgtatttttgcttgatgtctgggtagtttatttcagatgcttgtcagtttcattatatatttttgtttggggctcttgctggattttcaggtacaccataaaaacagttctctttgcagttagattgtcatgaaatagcttctgttttatggtatgaaaacactctttaatcttgaagggtgagtaattttgggaacattttccatttggtggtgtgttatgttcaaatggtaggttattttgaaataggatagactttgcagctaagattccagatttagttcagttaattcattctttagtgagtttttcttgggaaaatattttggaattttcatttcaaatgcatcctcctcatttaagaaaaatccagatgagtagtttatttcacaatataataactaaataggatttataaagcagaaatttataaatcctttcttttgctgggacaaaggcaatggtgaaaattaaaaaaaaataaagttaggacatttaggtaactcaaagacagaacttaatggctgttaagattggagtatttggttttgtagtttttaaaccatatttaattttggccatatctatcttatttagtagtttaaaggataaacagttcaaacagtaagaaaaaagcagtttgtgttttgtcagttttcaactttagatatcagtaaatcattgctgtagctttctttatcttttgtttgcacaaaaaacctgttagaattatgtctgcggggaccatctgctgtggttcccagtcttgtcagtgtgataagggataagctgtataaacaggggcaccacaaaaaaaaaaaaaaaaaaaaagaaagcaaactgcttttagaagggaaaaagtatccatttaattttataacatagccacagaaattcatatgatttttctcataatctatcagaattgaggttgtaatatattttttcagaaaccacaggtccaagttatttctatggtttatcttcacattaatattatatctttttgattacagggtttctattttggaggtcatagcttttaaaagttcttcgaaaatatttcagtatagcacttgacattgcaatatttttcacattgtctgcttagtttctggatctttttttccctagccattaatttttctttcagttgaatcctcagaaatcatccttttcctgtttcatttgcaaggaggtcatgatgcttcgtaaggaacaaggcagtcatttccatggcaacacactctatcaaaacatcacaaatctgtcgtgccccttacctttaaactctcaaatgctaagaggaggaggtgtgtaaggagcagcattgttcttacagcataactatacgatcacaaggagagggaagtcaattaattgactcaaaagtaccttaagttgacttagctatagacatatatatgtaaggaatttatcttttatattgtattaaacagtgttttgaggatggaaaaatgaacattccaaaactctgatttaaagatcttatttagtgtctgtgagaactgtaaaagaagaataaatagctgagttatgtcatacatgtaaacatgttacacagttactccagtcatgagaagtctacctttgcctggaggccccagcacatgtctctgtcagtcattttggcttaagctaggatattttcagcatgatagtgacacctatcttttaaacaagttccagaattttgtcaattttctttttctttttaaccattaagaggaggtgttagcaagatggcgtgactcctggatatggaataggagaacaattggtgtttcatcattactgaaaattttatgctctttgaaatcaggtatgaagtataataaaaatcaacagttttatgagattttgtggtaaagcaattcttattttattaacttcaagtcttctgcattttcagcatttcattttattctgtagcatttttactcctgggtaatgcatttatttgtgtgacctgtgaagatggtaaattttgcaatgcttagcgccttctgtttccccatgttccttgtagcaaactctatgctagtccttatcatagaacctacctattgtactttaggagtcagctcacaggactgacacctcccacttgactgtagccaccttggaggcaggagcttgcttttctctgtgtgtggcgtggagcaggtgttcaataatgtttgttgagagaacagtggtcagaatgaatggaattagttgtttgtgataatgtttattttctctatatggcacaggtatatatatattttaattttttactgtgtatgtctaaaatgaggttgaaatatgttctccatacccattttgtatttaacaatttttttgtagtgtattttgaaatcttggtaggctatttccttttgccttttcaggcctccatacactcctattacaagaggacttctgtctctgttccacatttcccttcgttgttggcgacctaaccttggtgaccgcaagcgatcggttgtgagagaaagagctgtaagtggggaaggctttccgagtctataggtactacctggtggcagtattaacacattttattatgaactatttgacagagaaaaggattaagagaataaggaccagttatatatcacctactcagatttagaaatgaaacattactgatatagctgcagccctccatgtagggggcgggggttaggtgggagtatatttttcattttcactttgtacctttttgctctacaaaagcttcagacttcaaaagaaatctttccttgctctgtgctttcatagtactaccccaggcctaagtgtattattgaacctgccagtgtattataaccatctgttcagatgtctgtcacctctaccaggctgtacttcatctttgtattttcagtaccgtacataatagctagaatggaataggtgctcagtaagtgcttgttgtgtgaatgactgaatgaatgaataggtacaattcttttctcaaaataccatgttaatgtaggattctgtttagcaaaactatttccttgtctagcccatagttacagggccttggtgctctgatttgaacaaattgaattaaacataaaatcctgtagaacagatgcatttacaagtctctgctcacacagctgctggtctatttaataaaaacattgctgttttgattgggtattcatagcctttctttttgttaactctattagtatcatggtataagcagactacagtctagggaagatgagtggaagaatgagccagtgatcagaactcagagagacaataggagatggatgtcaagaagatggatggggaaaatgttttagtcttaggtgtagttacaataaaaagaacaaatacatgtatttgtcttccctggactatatgtcataaatctctgactccatatttcttatgcagttattgtaaccttccttcccctaaaccacctaagtatgtataacattcctactctaaattacaaaaaatcgatactgatgcatttgctttttaaatttttaaaaattcaggtataatttatatccaataaaatgcatagatcttaagcattcagttgagtgaattttttttcccatttatgcacctatgtaaacactaccccaaacaaggtaggggatatttccatcaccccagaaaaatttttcctacctctctcccatcaaccctccttttcccttcccctcccctctgcagcagccactttctgattctgatttcacttgttcttgggagtcatatgaatggactcatagtatgtacttttatgtctggcttcttttattcaagatactgtttttggattcatccatgttgttgcatgtataaattcgatttgcttctagcaacagaaatgtgtatactagcaatcaaatacaaatttacttttaccttaaagttgagagattgagtagtgcttttttaagaggattgttagtagacttccacagcaactcacatatattgagtgccagtccctacgctcagtgctttacacacattatcttatttaattgtgttttgtgattgtttgtttagttgtttacttaattctctacggcagacatgttcggtgaaagcattgacatctgatgaagaagttgacttggtgtttgacaaaagaaactgtcttgtgatataaaattctgattgttttctcaggactaagtactaagcattgtttatggcaggcatcgatgagcttaaatcatgaaacaggaggaaaagtgtaaaaggacaatggaagagagttactgggtgggaaagaaagaagtgcagtagctagtttagattcgtcttatacaatctgtgatgaaacttttgagacagagtctcgctctgttgcccaggctggagtgcagcagcgcaatctcggctcactgcaacctctgcctcctgggttcaagcgattctcctggctcagccttccgagtagctggcattacgggcctgcaccaccatgcttggctaatttttgtatttttttggtagagacagggttcaacttgttgccctggctggtctcgaactcctgacctgaagtgatccacctgcttcagcctcccaaagcactgggattacagatgtgagccactgagcccggcaaagttgcctttcttcatagaagaaagttgcaaaatatacatgaatgaaagtatattacatacaatacggatgcctgaaaaaaagcatatgtaaattgtgcttagcctctcaaagatgcttgtaatcagtgcccttatttttgttcagaattatatcaacctagttttgagtttttacatatagcttttgttttaccagcacatatgtaatacctgttatggtgccagttcattgtcctaattgctttatgtatattaattctcaaaactctgtgaagtgggaattttttctgttttttagtccctgttttccccatgaggatactgatgtaatacgaagttaaagaactggaccagagtcacataggtagtgcaagtggggctggaattctaacctggctggtctgatttcagagcccgtgctcttaatcactgcaccgtgtgcctcagcctcccctctccctaacatgctcctcattcgtccttgatcctagggatgatgctggttgagtatttcaaggtttgtaaagattgacagtatcaaaacagatgtagcaactgggactttgataatttctataattcacaaaatagatcttaaaattgcatagttctgttttttgtaggggagggaaggatatgtaggaagggatgatttataatttgaaatctggcagcagtagagcacgtaccttaagcctcagcaaagctaattacataaccaattttgtgcttattcaaggctgtatttatagtagattggtgtttctgggctagttggtcgtagaccctgggagtgagagaccatagggacggtctgtgaatgtacgtatgtttgaattaggcaatggcaattggaagtattttattaccacatgaggtcctggtactcagattgggcacacctgcagtaggttgttgacatttgtgaatctaacatttggggtttcaattattttcaagcccccagaaagtccatgacattcagtagtttgttatgaaaataatatcagtttcatagagttgtggggttctgagaattaaataaaaataatgtgtgtaggcgttagctgctggaaggctggaatacagattctagtcatttggtgagtgagtgaacctagcagaggtcctcccgtgtctgcttgtgacattctgcatttgggagtctcaggatgcatcagtgactgtgctgtcggtgcactattatggccacttctcatccttgctggactgtgagtcttctctagactcagggcttcagagttacttctgcccctgtgtccttcatggaacacttactttttacttctgtttggtctttcaatataaagttcctttatttttaattaccaaacttccctctccaggttataagtaaggtggtttttggccatcacctttcttagctatgggttaaagcattctgggtactattttctcctttttatcaccatgccatagcccttgtgtctctcccttcaactcatggttaggttggtttcattggcactttacttttttttttttagatggagtttcgcttttgttgcccaggctgaagtgcaatggtgcgatctcggcttactgcaacctccatctcctgggttcaagcgattctcctgcctcatcctcctgagtaactgggattataggcatgcgccaccacgcccggctaattttgtatttttagtagagatggggtttcttcatgttggtcaggctggtttcgaactcccgacctcaggtgatccgcccaccttggcctcccaaagtgctgggataacaggcgtgatacttttaatttttaaaccttaaaatacattattaatttttccaagagaagccccgatatttttgtagcttggcctccagagcctcagttatccctgatgtagtagatcatctctttgcttccaactaaagtggagcattggatgttgtttgttaaggagtgattttcccatttactaactcataaaatttgctgactgtgttttttggtaagaagtcttataatgctttcaatttcataagagtcattttcatagagtccatgcaatatacacttagagtgtaaaagatactgagttagatgctgtaggggctccagaaatgaagtcctgtctttcattcttacaaagtgttcatccttttaagttccttgttaatgtttggggcaaactaaatataattttttggttagactttaggtaaatatttgaagaaaaattttatatgctatattaaatttttattttatcacaagtttcattaactttcacttttaatgccattctttatgaaatgtcagtgttaaagtgaccccagtagtgtgacaggcaaaagggtcagtaatgatggcttctttagtagccttcagaactgagcagtttgagattaacagccaatatgaactgcctgcagtaatcattaaaatataatctccagttttggtatgattttacgtatctataatttataataaatgtcttgaagttgcaggtttttttcctttgcaatgaatcaataaattatgtcacaacccttaaccccaagtttttgctttagcaattcaggataatgccaaaaacttacttagcttttagtctgtgccaggcattgttctgaacaaggtacatacaatgctgtcttgtagaccctggatttggaaagcccccaatccctttataaagcatatgtataagttgtatagataagtgtattttcaaaagtaaacatataaaaattcataattgatatttgaggatcaaatattttcctcatttatgtatctaacccacaaaaatttaattgtttataagacattttatggagacctttacatttatatgaagtaaaatttaatatgttccttaactatccaatatatttgagtatctgtgagatatgctatgtgctgagggatacaattaaaaaatagaaaagatttgattcttgtctttattttttcaattatttcaggtggcaaacacagatggtcacaatataatgtgacacctccattttcccaatgagaatattaaataaattgttttgactaacttgaatatgtaaactttagagatgaagatgaatttctgtatatttatttaagttatacatacatatttaaaatagcattatatgagataattttcaaatgtaactcttctctcctggcttttcatgaagcaattttatctaaactcttcaaatgcatctttgacatatgagggtttttttcctctctagaacctctttttgagttgtctgacacagttttctacggttccatttgaattgtctgaaatccaacctattttgaatctatttacgttgtggtcactggaaattttctctcaggagcccctccattctcattattaaagatcagttggttttctttttcctcctgtagaagcatgtatgttgatctctgtagtgtaggcacttattataatacttaaaaaaagtcatttttgcaaggcttgtttacaatgaaatccaatatttgccaatgtgaggcaatatccctaggagttaaatctgtgttaaatctcatcgcagcttttactgcaatttttactgattcagatgattgtttctgggggacttctctaagcttccacagatcctgttacttagggtaatgtcttctccaagtgatactctgttattcaaagtaggactggagagagtaaaaagaggttctggtaataagaaagactttctatggactttattaatagaaatagaaaacaatttcctattttctgagggattttttttgggaaaagtaaactttgccttacacttgggcatttgttgagttgccagctaacatctcttagcggggagttggtagataggttctatttaacccagtgtttttcatgctgttctattcaccactgcatactgctttgccttgccgtgaagtgtactctttttacccaattcctcattttcatatttctgttttcatagtatcttgttagacttttacttcttgagtcagatgaagaaaacttaatcagtattgatgtcttcagtatcataaatatctgtaactcttactttgaatgtaagagtaatgttctgattactgctaagattctaccaaattgactttcagtacatattgatgtatttctggaatgaatgttcctgtgatcttggcttgcagatgaaaaccttaatatttgaatcagactggtgcaatgtggaaagacaaaatacacacttgaaatatttgcatgataatctacggaacaaaaacatttagtgggagtggtggtagaacgtttccaggatcaacacttgaatgctgtgagagaactatttttttttttaatggatggcaggtggcagagttgaaaaacaggtttttataatggaaatgctaagagtcttagctataggagtatgaatggtattgttacaatagatataatagatgtattgcattatcttatctcatcagacacttttgttagtaaaagcgcccccccccactagtttcagtctgctcttgcagagaatcactcctctcaacaatttttgctacttacaaaatttttgagattcaagatatctttaatctgtcgagtttcagcagatttaataagcataaatttattttattaaaaatattttaagtcaggaaagtaagtataggaaacagaccagatgtaattcagattacaggatctggatttgcccctttaatgaatgtcagctatgctggcaatattctgctggtttcctttttttttttttttttaacattactactcatatttcacatttgatttgttttcaatatccttactcttaggaaggggcttaggaaattgaattacattttatatgtttagttcctaatctcattcttattttaatacctgttcagattcttaaggctttttgtaaataggggtctgtggtgtctgtaagtctgggggcctaggagggagtctcacacaggagtccggtttgatcacagtggatagggtactctacagtgtgcttaaaggcaagggggctctaagaaagagcagccctggtcagtgtgttctgagaaagcagggcagtgtctgagaggtgagttaaaataggagtgagtagtcaccattttgggatattagacaggaagtgctttctgtacatgcaggctggaaatgcacacaaccctcctgccccatccgtgagcagtccagtgtggggagaggaaggaaggtgggatgtggttggtcataactgtgatcccttttcttctctataatgctgagtgttcacaattgagaactgactggtgagtccttggtgagttaaggcttaagctgaggtccctgggtagttaggtagttctaagaatgtatttgttcaatagaacttttgaataacttcacttagctagcttgttagtgctaggaacccaaagatgacaaacagcccattcctctgaaaaactgtgactctggtgaggtgcatagttatttagacctgccggatgagaataccacttttccccgcaccaaatctacctgctggagtgaatttatttcatgtagactctgaggtccctctgttgcttttgataacgtgctctcatctgaggccagctccgttacttgtatactcatcctgtctcccccgccaaggtcattgctcctgcagttttctgctttctctgttggatcattttccttctttgctggatcattcctatcatcaaacattctgtgatatatcctaccttaagctaatcttgtttctttttttttttttttttgagacggagtctcgctctgtcgcccatgctggagtgcagtgacatgatctcggctcactgcaagctccgcctcccgggttcacaccattctcctgcctcagcctccccagtagctgggactacaggcgcccaccaccatgctaatttttttttatttttagtagagatggggtttcaccgtgttagccaggatggtctcgatctcctgacctcgtgatccgcccgccttggcctcccaaagtgctgggattacaggcgtgagccactgcgcccggccgataatcttgttttttgacaccacattcttactctccaacttcctgataccacgttcttcctctccaactattccatttttttctttctctgtaatagcaaaattccttggaaggacctgctgcttctctttctgtttctagttcactctacggaggcccttttacttgaaagtgctctcatcaagttcaccaatgacctttgcttggccaaatgcaaatgccacttctcagtccttatcttatatagtctttgtttgttagcatttgccacagcttttcactctttccttctggaaatactgtggccttctggacactactcccccttgcttattggttctcttcctatttcactggctgccccttcagtcatctttgctggttccttcttatcataccgaaatgttggagcatccccaaggcactttgttttacttttccacctatactcacttatttgggtttttatagagtcccatagcttttaggtactttctctatgctgatgcttttttttttggaaccctgggctctctgcttacatatcatctgaatttggatctttaaaaggcatgtctatttaccatgtccaaaactactaatctcccccacaaatctgttgctccatgttcttcatatctcagtaaaaggattctgagtcttttcagttgcttgagccaaagactttggagtcaaggataactacttgtttccacatcacacactgagtctatcagcaaatcctgctggctctacctttaagcatatccataatcctatcatttttatcaccttcacttaggctaccactgtggtctaagccagcatcatcttgcctggattataatagttacctgttttatctcctagcttttccctcaaccatctgttttccacacagtgatcagagattcttcgaaacctaagtcagattattttacttttctgctcaaaattcacaatgctgtctagtacaactttctgcaaaaatggaagtgctcggccaggcacagggtggctcactcatgtaatcccagcactttgggaggccaaggtgggtggatcacctgaggtcaggagttcgagaacagcctggccaatgtggtgaaaccccatctctactaaaaatacaaaaattagccaggcttggtggccagtgcctataatcccagctacttgagaggctgaggcaggagaatcacttgaacctgggaggcggaggttgcagtgagccgagatcacgccactgcactccggcctgggtgacgagtgaaactctatctcaaaacaaacataaaaaaaggaagtgctctaatctgtgctaatatggtagccactggccatgtgtctgttaagtacttcagatccggctagtgcaactgaggcactgaattttaaattttattttaattgatttaaatgtaaatatccacatgagtggaagccaagatttatatcatgttctgaggtttacaaaggccagatgaagtgaacaccttttctacttctcttgacttcatctcctgctaccactgccgccctcattttcttgctcttctttgaatataccaagcatatgcttgcacttgctattccctcatgcctggaatgttcttcctccaggtgtttttttttttttttttttttttttgagacggagttttgctctttttgcccaggctggagggcaatggcaagatctcggctcactgcatcctctacctcccgggttcaagtgattctcttgccccagcctcctgagtagctgagattacaggcgcgtgccaccacgccccgctaatttttgtatttttagtagagacgcggttttgccattttggccaagctgatctcgaactcctgacctcaggtgatccacctgccgcagcctcccaaagtgctgggattacaggcatgagctaccacgcctggcctccttcttttcattttaggggatgagagttcgaagctaacagataataaaacttataaattatctacaaaccaagaatctgaattgttgaaattttcactttacaagagaagatctagttaggtttatatgataatcttgaactgctacaaaacagatgctgtgggctgggcatggtggctcatgcttgtaatcccagcactttgagaggctgaggtgggaggatcgctttagcccaggagtttgccaccagcgtgggcagcgtagtgagaccctatccttacaaaaaattaaaaaattagctgggtgtggtggtgcccacctgtagtcccagctactctggaggctgagatggcaggatttcttgagccccagattttgaggctgcagtgagccatgatcatgccactgtactccagcctgggcaacagagtgagaccctgtctgaaaacaaacaaacaaacaaaccgcccccctcaaaaaaccaactcaatacaccagaaccaaaaaccaaaaaaaacccccagaagttgggtactgtggctcatgcttgtaatcccagcactttgggaggttaagttgggcagattgcttgagcccaggagttcgagaccagcctgggcaacatagcgagaccctgtttctatgaaaaatataaaaatttagccaggcatggtggcatgcacctatggtcccagctgctaaggaggttgagtgggaggatggcttgaagcctgggaggtggaagttgctgtgaggcaagatcatgccactgcactccagcctgggcgacagagcaagaccctgcctcaaaacaaaacaaaataaaacaaaaacaccacaaaaaccaaccaaacaaaaaattgttgctgtgggaatatttgatgggtttaatacttgttaatatccagtagagataattaaggctgatccttgattccctttccctagcattttattgtggttcatttaggtgttctcaatgttgagtgaacttttcaaaaatactcttccttctctataacccaaagagtatattcttcaaagctaccttctacatgactccctcacccaaaaattcatctttgtttctagcagcctacgctactcatttctttgagcccacctttgaatttaggacttgtaaaattataaacatttataaatgtttgatctctatgtccatggaacagctttaaaaatcttctttaatctctgagatgaggcagtcaagaataaggcatcttcgattacagaatctctttgaagttttctttctatttcaggttttccctctagcactcctacgttcggtagctctaaggtggatttttttaattaatctttttcctttttgcttaggtatccttggcagtctttcaaaagttaagaggcaacattagtaaaattatactttcaaactttatcattttcgaactctgtttctctagtaagttaatgagctagagacctccttttaaaataatctcatctattttacattttaatgctgtttctgttgtagatattacagtcctaaaaatgtgttattttcttagagtagactggaaagctcaaattaatcaatatgtctccagcctagctaccatccatttctgttttataggattatatacttgtttattttataaaatggaaagtttgaaatcttataatattttcatttatggttttatgtgaatcaaacagtcttggttcaggtgatttaaaaatatcactacaaaaaggagatatcttgcttatttttcattcatgtagtcctgtgtgaaattattggtggtctttctgtctccgtgaacatctgcagccacacagagaaattttatttgccttttgttatcagattcacatattatgaatgttgaggctagatatcattgatatcattgattagaaccattaaaatactaaagatactagtaaagaaaaagatactaatgacaaaaaaatactaatcttgcatattaatcttgtttttacttcagtgttagtaaaaacactagtaaaaagcagttagttacttcctttttattttgtatttgacattacacacacatgttctgcacgttctgagaagaaagtgtcagattgcttcctgtttgagtttagatgcaatcgctagtcttgctgaaagccaatgaaattgaaaggcttagctttgtaagtagaatttctgtttctttaactctatagttgataatattgtttctcaagtttcctttggtaggtattctcagggaacgttccaggatcttgtaatacttcttgtttgattagaaaatgattcattacgtgcctttcagctctttaggaaagtggacggccttcacatcagtgggattgaattcagaaaaagaacatactactaaaagtacttttgtaattattttattagtttttctcatattattagtttttctcatatttcagtgaaatttcttatattattagtttttctcatattcagtgaagtgctaaaaatgatgtccaaatttatgtttaaagtttcacagagttatacactgactttaaaattgcattgctttattttaaggattagagaaatggtagtgcacgggttaagaatttgggtgatggcaccaggctgtgtaagtccaagagccactttgcttgccatgtgactttgagaaagctgttccatctctttgtccccagttttctcatttataaaatgaggataatagtgcttattccatatgacagttataagtagtaaatgaatttaaatgaaaatatttaaggtacttaaaagtgctcatataagtagtaggctgcttattgtattgtactaatattaatgaagtattaacagttgttaatactgtgttttaattcttgctctttcatttgatagtcatatgactgtccccaggttactttactttcagtctcatttttcatctttaaaaacaagattatattatgttgtatctaataaggccatcatgatgattctagactagatatgcaaattacctactatgcacagagtaagggcaccataattttatttttttgtttttattttttatttattttattatactttaagttctgggatacatgtgcagaatgtgcaggtttgttcaaaacataggtatacacgtgccacggtggtttgctgcacccatcaacccatcatctacattaggtatttctcctaatgctatccctctcctagccccccactccccaacagcccccggtgtgtgatgttcccctccctgtgtccatgtgttctcattgttcaactcccacttatgagtgagaacatgcagtgtttggttttctgttcgtgtgttagtttgctgagaatgatggtttccagcttcatccatgtccctgcaaaggacatgaactcatcctttttatggctgtatagtattccatggtgtatatgtgccacattttctttatccaatctatcattgatgggcatttgggttggttcctagtttttgctattgtgaaaagtgctgcaataaacatacatgtgcatctgtctttattgtagaatgatttataatcctttgggtgtataccgagtaatggggttgctgggtcaaatggtatttctggttctagatccttgaggaattgccacactgtcctccacaatggttgaactaatttacactcccatcaacagtgtaaaagcgttcctatttctcgacatcctctctggcatctgttgtttcctgactttttaatgatcgccattctaactggcatgagatggtatctcattgtggttttgatttgcatttctccaatgaccagtgatgatgagctttttttcatatgtttgttgaccacataaatgtcttcttttgagaagtgtccgttcatattcttcgcccactttttgatggggttatttttttcttgtatatttgtttaagttctttgtagattctggatattagccctttgttaaatggatagattgcaaaaattttctcccattctgtaggttgcctgttcactctgatgatagtttcttttgctgtgcagaagctctttagtttaattagatcccatttgtctattttggcttttgttgtcattgcttttggtgttttagtcatgaagtctttgcccattcctgtgtcctgaatggtattgcctaggttttattctagggtttttatgattttaggtcttacgtttaagtctttaatccatcttgagttaatttttctataaggtgtaaggaaggggtccagtttctgttaggggtccagtttcagttttttgcatatggctaactagttttcccgacaccatttattaaatagggaatcctttccccatttcttgtttttgtgagctttgtcaaagatcagatggttgtagatgtgtggcattatttctgaggcctctattctgttccgttggtctatatatctgttttggtaccagtaccatgctgttttggttaccgtagccttgtagtattgtttgaagtcaggtagcctgatgcctccagctttgttcttctgcttaggtttgtcttggctatacgggctcttttttggttccagatgaaatttaaagtagttttttctaattgtgtgaagaaagtcaatggtagcttgatggagatagcattgaatctataaattactttggatagtatggccattttcatgatattgattcttcctatccatgagcatggaatgtttttgcatttgtttgtgtcctctcttatttccttgagcagcggtttgtagttctccttgaagaggtcctttacatcccttgtaagttggattcctaggtattttattctccttgtagcaattgtgaatgggagttcactcctgatttggctttctgtttgtctgttattggtgtataggaatgcttatgatttttgcacattgattttgtatcctgagactttgctgaagttgcttatcagattaagaagtttttgggttttctgaatatacaatcatgtcatctgcaaacagaggtaatttgacttcctctcttcctattcgaataccctttatttctttctcttggctgattgccctggccagaacttctaatactatgttactatgttgaataggagtggtgagagagggcatccttgtcttgtgtggtttttcaaagggaatgcttccagcttttttttttttttttttgagacagagtctcaccctgttgcccaggctggagtgcaatggtgcaatttcggcccactgcaaccttcacctcctgggttcaagcgattctcctgcctcagcctcccacgtggctgggatcacaggcatgtgccaccatgcctggctaattttttgtatccttagtagagatggggattcaccatgttggatgggctgtctagaactcctgaccgtgtgatccacccgcctcggcttcccaaagtgctgggattacaggtgtgagccgctgtgtttggcctcagcttttgcccattcagtttggtattggctatggatttgtcataagtagctcttattattttgagataggttccatcaatacctagtttattgagagtttttagcatgaaggggtgttgaattttatcgaaggccttttctgcatctattgagataatcatgtgttttttgtcattggttctgtttatgtgatggattacatctattgatttgcgtatgttgaaccagccttgcatcccagggatgaagccgacttgatcgtggtggataagctttttgatgtgctgctggttttggtttgccagtattttattgaggatttttgcatcaatgttcatcagggatattggtctgaaattttctttttttgttgtgtctctgccaggttttggtatcaggatgatgctggcctcataaaatgagttagggaggagtccttctttttctgttgtttggaatagtttcagaaggaatggtaccagctcctctttgtacctccagtagaattcggctgtgaatccatgtggtcctgggctttgttttggttggtaggctattaattactgcctcaatttcagaacttgttattgctgtgctcagggatttgacttctttctggtttagtcttgggagggtgtatgtgtccaggaatatatccatttcttctacagtttctagtttatttgcttagagatatttatagtattctctgatgatagtttgtatttctgggggatcagtggtgatctcccctttatcattttttattgcgtctattcgattcttctctcttttcttctttattagtttggctggtggtctatttcattaatctttaaaaaaaaaaaaagaaacccagctcctggattcattgattttttgaaaggttatttgtctctctatctccttcacttctgctctgatcttagttatttcttgtcttctgctagcttttgaatttgtttgctcttgcttctctagttcttttaattgtgatgttagggtgtcaattttagatctttcccactttctgctgtgggcatttagtgctataaatttccctccaaacactgctttatctgtgtcttagagattctggtacgttgtgtctttgttctcattggtttcaaagaacttattcatttctgccttaattttgttatttacccagagtcattcaggagcaggttgttcagtttccacgtagttgtgtggttttgagtgagtttcttaatcctgagttctaatttgattgcactgtggtctgagagactgtttgttatgatttctgttcttttgcatttgctgaggagtgttttacttccaattatgtggtcagttttagagtaagtgtgatgtggtgctgagaagaatgtatattctgttgatttggggtggagagttctgtagatgtctattaggtctgcttgttccagagctgagttcaagtcctgaatatccttgttaattttctgtcttgttgatctgtctaatgttgacagtggggtgttaaagtctcccactattattgtgtgagagtgtaaatctctttataggtctctaagaacttgttctgtgaatcggggcgctcctgtattgggtgtgtatacatctaggttagttagctcttcttgttgcgttgatccctttaccattatgtaatgcccttttctctgtgtcttttgatctttgttggtttaaagtctggttcatcagagactaggattgcaacctctgctttttttttgcttcctatttgcttggtaaatattcctccatccctttattttgagcctatgtgtgtctttgcatgtgagatgggtctcctgaatacagcatgccgacgggtcttgactctttatccaatttgccagtccgtgtcttttagttggggcatttagcccatttacatttatggttagcgttgttatatgtgaatttgatcctgtcattatgatgctagctggttattttgcccattagttgatgcaatttcttcatagcattgatggtctttacaatttggtatgtttttgcagtggctggtactggtttttccattccatatttagtgcttcattcaggaactctagtaaggcaggcctggaatctctcagcatttgcttgtttgtaaaggattttatttctccttcacttatgaagcttagtttggctggatatgaaattctgggttgaaaattcttttctttaagaatgttgaatattggccgccactctctgctgacttgtatggtttctgcaaagaaatccactgttagtctgatgggcttccctttgtgggtaacctgacctttctctctggctgcccttaacgtttttttcttgatttcaacctttgtgaatctgacgattatgtgtcttggggatgctcttctccaggagtatctttgtggtgttctctgtatttcctaaatttgaatgttggcatgtcttctaggttggggaagttctcctggatagtatcctgcagagtgttttccaacttggttccattctccccatcactttcaggtacaccaatcaaacgtaggtttggtcttttcacatagtcccatagttcttggaggccttgttcattccttttcattcttttttctctaataatgggttatttcattaagttgatctttagtctctttagtctctgatatcctttcttccgcttgatccgtttggctattgatacttgtgaatgcttcttgaaattctcatgctgtgtttttcagctccatcaggtcatttatgtttttctctaaactggttattctagttagcaattcctctcaccttttttcagggttctttgcttccttgcattgggttagaacatgctcctttagctcataggagtttgttattacccaccttctgaagcctacttctgtcagttcgtcacactcattctctgtccagttttgttcccttgctggcgaggagttgtgatcctttggagaagaggcattctggtttttggaattttcagcctttttgcgctggtttttcctcatcttcgtggattcatctacctttggtctttgatgttgttcaccttcggatggggtctctgagtggacgtcctttttgttgatgttgatgctattcctttctgtttgttaattttccttctaacagtcaggaccctctgctgcagggctggtggagtttgctggaggtccactccagaccctgtttacctgggtatgaccagcagaggctgccgaacagcaaagattgctgcctgttacttcctctggaaacttcgtctgccagatgccagccggagctctcctgtatgaggtgtctgtcaaccccttctgggaggtgtctccaagccaggaggcacgaggatcagggacccacttgaggaggcagtcctgtcccttagcagaatttgagcactgttctgggagatctgctgccctcttcagagccggcaggcaggaatgtttaagtctgctgaagctgtgcccacagctgccccttcccccaggtgctctgtcccagggagatgggagttttatctataagcctctgactggggctgttgactttctttcagagatgccctccccagcgaggaggaatctagagaggcagtctggctacagcggctttgccgagctgtggtgggctctgcccagttcaaacttcctggcagttttgtttacactgtgaggggaaaaccgcctactcaagcctcagtaatggtggacatccctccccacaccaagcttgagtgtcccaggtcaacttcagactgctgtgctggcagtgcgaatttcaagccagtagatcttagcttgctgggctctgtgggagtgggatctgctgagctagactacttggctccctggcttcagccccctttccaggagagtgaatggttctttctcgcttgcattctaggcgccactagggtatgtagaaaaactcctgcagctagctcagtgtctgaatggctgcccagttttgtggttgaaacccagggccctggtggtgtaggcacccgagggattgtgaagaccatgggaaaagtgtagtatctgggctgaagtgcactgttcctctaggcacagtccctcacggcttcccttggctaggggagggagttcctcgatgccttgtgcttcccaggtgaggcaacgccccgccctgcttcggcttgccccccatgggctgcccccactgtctaaccaggcccgttgagatgagcctggcacctcagttggaaacgcagaaatcacccgccttctgtgttgatctggctgggagctgcagaccagagctgttcctatttggccatcttgccagccacccctttatttttattttttatttatttttatttttattttttcagacggagtctcgctttgtcgcccaggctggagtgcagtggtgtgatctcaactcactgcaacctctgcctcctgagttcatgccattctcctgcctcagcctcccgagtagctgggactacaggcgcctgccaccacgccttgctaattttttgtatttttggtagagacggggtttcaccgtgttagccatattggtcttgatctcctgatctcacgatccgcccacctcagcctcccaaagtgctgggattacaggcatgagccaccattttttatttttttgaggcagagtctcactctttgaaccaggctggagtgcagtggcataatattggctcactgcaacctctgcctcacaggttcaagtgattctcatgcctcagcttcctgaatagctgggattacaggtgtgcaccaccatgcccggccagtttttgtattttcagtagagacagggtttcactatgttggccaggctggtctcaaactcctggcctcaagcaatccacctgcctcggcctcccaaagtgctgggattacaggcgtgagccatcacacacagccccataattttattaatagtagttgtagttcagtttttataattttctctcctgaaaaccctgccggatacccattttcctttttgtttaatctattgtaatatttaactgtatcctgctaaattgatatctagagagtttctaaaaggaggaactcttgggattcagggctttagacacgattgaaataaatgtctttcttaattgcagaccgtgagagaaacgtggtggtgatcattaagtttccactactgagtgttaaaaaaggatgtgagtgctgagccaacattttctctctcttttatctcctgttattccctcctctctgtccattaatatctgttgtgaggtggttatggcagctggagttatagtgcggacatgatagtgctgtaataggaactgcagtcctttcattttatagtgatggcatgggagccacggaaagctgtaaagcattggagggttacaagagttccagaagtactgtaagaaacctgaagttgcatttccttacattcttatatttgtgatggttatagttagaaaaatcactggaataatttggagtctagggaaagctttggtgtgggctagttttgtatgaatatttacttttgttaatattacataccaatttttgtttctaaatggaaaccttagcttactgagcttcacattgattttgaggactgtgtagtggtgattgaaaaataggttacagccattttggaagagagaatacactggacttttacatgaagtatggcatacgatacatatctgacacatcttgctaaaaagcaagtccttaatgacatgacctcccatcttgagcatagacacatgttttaaattcataaatgatggcctattgagagatatctattgtgttcattaaaatatacatatgaaacgaggatcaaattaaacatttcaagtagctaattttatcagctcttaataattaattagtttttagcatttagaatgaaggtaattaaaatagatttactacatgctataagatttctgcctctggaagatgaaaggggacatttatttttcatatgcttaaacattggcgtttttgcttttgttctatggggattttgtatgtaacaaaaaaacttactgagttattttattatgaaattttaattataaaatatctttaatgctttttagtcggcctaaatttaattgtagtttgttggaatgttacaattttattttaaatttctaaagttaatataaaagtcttttctgctactgtggtgtattgttatatcattttatttatatttttataatttgatttttaaagtgggtcatatctttacatagttcaaaatacccaaaatataaaggcaaaagtttttttcctgtctggattccttatttgcttggttctcctataatctccaggtaaaaacattagtttcttgcatatccttccagagtttatacaaatgcaagtagatatacgtacatattataagttttttcttttatcacattttaaaaagtataaatccagagatattaagtaatagataataagtgttagatgtcagataataacttgtaaagaataaagttgcattattgttatacttggaaataaaataatttaattacatgtctctctccagttatttcaggttgagtgtacgtttgcttcgtcttcaaagtagaaagttcctggagaagacctactctttctggaactgtttttgtttgacccatgctatgcaaacttactcattcatgcaaacactgggtgctttatgcaaatattaccacctgtattttttatttgtgtttctcaaaggagttttggcaaaatttgcataatgacttggctcatttagctttgtgtattgttaagagttcaaattctgtggatatgaaagtttacagtgtataccaaataaaaaggtcgtgtggtaggcagtgttctcaggataagcctgtgttaggtattcaaatctaatttgcatattggatctagacctatgactattaactccatttacagttgataaaaatttgcataaaattggtcatcttgatagcttaaggtatactgagcaaaatgttaactccttgggtagcatgtgtgactgtatgattgtcaagatgaaagttaatctaagcacatttggtttactgataatcatttctagaaatgagctgtagtatcatgtcagaatgtcagaaacatgtctgacaatttaccttttcatactagaaatggtggatgacatgtttcaaatcctggcagctgtgctgtatcaaatcctccctatgtgaatatcatgcttggtacttagatagtttaggagcagtactgtggcttgtgatttgttgtataattctgaaagaaaatatattaattttgtgcactttatattggctcttgctttattgtagcctttatccattaatctgctactgatggataatttctcaatcatttggtcctttttgtaatggctatgtggagttggcaattctttttattaaatattgcatgactgtatatgtgttaataatttattggggtagtgagctgatataaatctctttttagatgaagtttttggctatttacaaaggttgattactttttagaacagtgattgcctcagatttgcaaaggttgaggaaaagcacacctcttattttacctttttccatttgtggttaaacctattgtaaatatattggaagggttttaggcccttgaagacgcctctgtatttgaacagtttgattctgtcaatttcatttaaatcattattttttgtaagacctcaggataaataccacttttgaggtagtgactgaacaaacatgagttcttgaatagtttctattaaaatgttttttttaatcctatgagtggtctctgtgccttttaaaataagattttaaataagatgataattaatactcaagatatgatacttttatttatagtgatttggttgccttgatcatatttaatgatgatttaaaaaacctggatggagagagagatatatatgtatacatatatatatatatatacacacacacacatgaatgataaattattctgtaatattatttatacattcattgtttctagctagcaagcacccttagtgtatttaatgtattagatttatataattcactctatgtacaatattagattaggatgagaattatatgaaatgaggcatgccactatcaagtctggcatgtttttgttaccaagttctgagtgctgaatgagaaacagtcatgtatttactcagattgatcccggatcccctgagggaattggcagtttcctctggatggcattgctaaatcttcagttttctttcttcctcgctctctctgtggcccatacttaggtcagattactgagaaaatcagtgttattgacgaatgccttgtacatgattataaaagtctcaatacctctgagaaagatcagaaacacataattaaatgcaaatagggtaacttatttaattttgagttaattatagcttcatccaatgtcattgattactggggcagcacaacttggtgtccatctagtacagatgatagtgattcttattttttcttttagatatattaatgcttgactttgaggataacacatttttaattcagaactagtgtttaagttttttgttgttaagttttaacaaaagtttttcttgtgggcatgggaatggtaagtagtgattaaagttttgaatttaatggatataaggaagaaaaataaactgagaattgacttacattttttcttggagaggaggggattcagcactctcagagcctctcctctgttagcgtgctggtagttgatgaggatgaagttgatgagatgagcaagaatctggaaggaccaagcataggtatactaattacacagaactttaaaaatccgtgtatgattatttcattgcattgtagaattgcagatgagaaaagaatttgcaatatttaactcaaatttgttttatagctaaaataaccgaggcccgcagagattgggagatgtgtgtgaagccattgaatgagttactggcagcctagaatccagatcatatttattcaacctaatgccttcttctgcattattctctttccatgtttatttgttatacatacagtagttgttattggcttgctagatggttatgtatgattgagaaaggaggtaggaagacctaatgaaaagtttatttcacgattctgctgaagacttggtctgctgacagttaataatagtagctaatataacattgagaacttgctgtgtaagggacactgtgcaaagagcttcatgggtacttacatgtaatctccacagagttctctgaggtagatagcagtattataatactattttgtagatgcaaaaaccaagtcttaaataggtgaagtaatttgctaaagatacttatctactcagtatgggggcacatatttgaactcctaccatatcccattctgcttccctttatttatcagtcagcatataagggaaggtctttgaacagatccaaagcccttgtcagctctcatgtccagtgactactggaatttaagttttttccctctttttctaagaaaatttttcttttcattataatatgaaaatcagctaattgaatctcaccccagatttcaagggattggactccttcatgtcaagtttattctggatagtctctcagcccttagggaggaatggggttagcttgctattattgcttgctattatttggtcctcaggattttaggcttttacgtcgtggttagtggtttatcaaccatcctgaaaatggcataattatagtcttttgaggattgatggtagatgaacaggttacctgatttacctttccttgggaagttggaacacttgcctacctcttgcctttccatattttcttctttctccatgattcctcagaggttacttacttactgattcagcagcctcacttggttgttctttgattccctgggatatcagttttctgggctgggtttggagcagtgaggcattctttattcttcttacccactgtggcctctaattccttttaaccatattcattgtatgcttttctcatctgaagaagatggtcacatccagtttctcagtgtgaggatgaaaaactcactggtaatttttgttttgggtctccttattgattaggactctagtcctgtcatactgattaaatctcagaagggtatagatgtagggagtggaatctgcttgttcccactgagttcggaaacaaggaggatactgtgagcaaaggtttattcagtgatttttcttcctcttctactttttctttttctgtgtattatttggttctggcaagtaccaataaaagaatcaccgtgcagacctctaggattttagagcaaatttgtgccctctctgctgataatgattcttcttttgagaaacagttcctggcttttgactttgctagagactgaacacctactcatgagatctcaggtgaccatgtggctgagtttcccatcatgaattggctgttgtctgacctgtttagccataggttgggaacaagcagcagctatctgttattaagtgaaaatggtatataagagaccaaggttgggcaggtccagataatataagtaagttaaacgagctggtggctcagactcctttgataccaacttctgttccattgcttccactccttcactccatgtgtatggtctcctgggatgttccttatggaccatttgagtgaagaagaaaatttgagcctagtttataagtgggtctggatgatatgcaagtgttactcagaagcagacacggaaacactaaagccccacaaaagactcaccatgaaggacaatggtgaaggaagatcttcccagtggacagaacttctgtgcattatattttgttgcctactatgtctgcagtaggagatggccagggacaaagatctacattgattaatgggcagttgctaaattttttttttttttttttttttttttgagacggagtctagcttagtcacccaggctggagtgcagtggtgtgataccggctcactgcaacctccacctcccgggttcaagcgattctccagcctcagcctcccagatagctgggattacaggcgcttgccaccacgcccggctaatttttgtatagttgctaatgttttatcttggtggtcagagacctggaacaaacaggatgtgaagactggtgacaaggaagtctagggaagaggtgtgtggatagacctctctgaatgtccacaaactgtgaaaattgagtgccatgtgaatgcctgttaaagggcatctactgcaaaggatacttgctagtgagctggacagaacaacgtgctgtgtgcatgtcagtcagccttttattcacccacattagggcttgctcagtggacccatgaaaaggtggctatattggcagggttgggagctcttcatgggttcaacaataaggtctttccctttacaagactgattggctactgttattgctgagtgcctaatcagccaactgcagagtccaacattgagtccctgatatggcaccattcactgaggaaccagccagccatctgctagtggttgattatattggacctcttccatcatggagggggcaaagatatattctcacagggctagtagcatattctgcatatggatttgctttctctacctataatgcttctgccagcaccaccatctgtagactcacataaaactttattcactgttagggcattctgcattgtattgcttctgatcaagaattccttctctagcaaagaaggtgcggctatgggctcgtgctcttggaattaactggtcttgccccataccccgtgatctgaaagtggctagcctaattgaaaggtagaatggcttactgaatactcctaatgctaattgaaaggcagtaccatgaaaggatggggttctgttttacaagatgtagtatacaatttgaatctgtgaccaatacatgtgctgtctctttgactctgggattcaaggggtaagtgagagtagctttgctcattgttacacctagtaactcacttgcagatcttttatttcctttcttggaaatactgagctttgctgagctctggtttggagaccttggacttcaaggggatagtgtttccactagaggatacaacagtggttctatgagattggaagatggggctgcttcttggccattttgcagtccttacactactgagcaaatactcagaaagaggagctaatttagtcactggagtaattgatactgataaccaaggggaaattggggatttgatacactgcagtcaaagagacaatatctgaaattcaggggattctctgggcacctcttagtacttccatccccaacagtgaaggttaatagaaaataataccagccaaaaaagggcaggatgattaatggctcaaatatttcaagaaggaaggtttgggtcactccaccaggtaaagaactcagagcagctgaggttgtttcatctctggagctttgatctgggtcttctttttaatatcctcgagttctatgcttaatttttgggtacactaataatggttataataactttttaatgatttatctattctaacatctgtgccaattctgggtcagttcttattctccaatttttcttctcattatgggattcctttttcttattttttacatgcctggtactttttgataagatgctaaacattgtaaattttacctttttggttgctggatatttttgtgttcttataaatatttttgagctttgttctggatgcagttaaattacttggaaacaggttggttctgttcagcatgactggagccatgctcagtcaagggctaattattccctgctactgaggcaagatccttctgtgtgctttactcagtgccccatcagtcgtgaaattttcatgactggctggtaagaacaggcattatccccagtactgagtcagctctgggcgccgttactccattcttttgaggtcattctttccccagctttggttggtttcctcacatacatgcactggtcaatgctcagctgagtactgtaattactcctctcaagtactctgtcttacaaactctagcaagccttgatttcctcaaattcttaactctgtcttagtgcagagtcttctggactgactgccttgcacaactgcagccaagtctggaaactgacaaagcagtaagctggggcaattgtagggcccacttcatttgttttccgtctctcaggggtcactgttctgcattgtgttatgttcaatgtcttgaaaaattattgttttatatgttcggcctgttttttggtcgtttcatgtggaagcttttaatgttaatgttatttctgagaccatatatttatataacattgaattggataagattaaacagaagaaacattatttagaaagttaaaaaaatttttctgcgtgagagcctgttgttagttatttagaatcacttcttaatcacagcaagatactttgttttattgaagatttgtttccctctagattttctccttattaaatagtagaacatagagaagagaacagttaaggtcggccggattgcttctgcaggtttgtgtccatagagaagctgaatgtgtagaatttcaagaaggtaattgagaagtccgggagtagagtttatctcaacaccaaaagaatcatttttaaataaatacagggtgagaaaagtgaagaatcaaaagagtagcttttgaagcacagtattcctaaggtcttgttttaaggatatgtttctgtgtttgttttttattgatttgagatcatcttaatgcgtgttagaaaatttatcaggctgaacgagttgatcctaaaatgctgcagaaaagttggatgtgaaatgggaaagaaaactaactttcatgagatgcttcgtaaaatctatttcaattcagggtgaaaattgcaaaactgtctgccaatgcgtttttgatggacattctggctatttgtgtgagtcttctgcattgaggttttatttattgagcttccttttgcttcactctagaccaggtggtttacatatgttatctcatcttgtccttctgacaaatcctgtgaggtatgtggtgttaatctcattttaaagatgaagattttcaggcttatagggtttaggtagttgacttaaggtcactggtagtaagcagggattatggctgggtctttgactgctaggcaagtattaacacctcatcacacacatgggctgctttttctgaaggtagtaggtggagatttctttccttgagtaaaagggcaaaaaagaaagaacgtaaagtagtttttagaagtagtttcttctggtcaccaaattaacaggaaaagggaaacttgtctaacctaggtgttgtgttttccccattattctgactacagtaatttctgttgaaataaccacagtcattttgttgaaaagccatacgtgtttctaaataaaatagttacataattttaagtgcatattttaattaattacacattcttttaaattattcatagactatcatagatttttatatcagttggcatctggagtcacaatgtaaatattagaaaaaagattcagaggacctttttcccaaataaaatcatgtgaccctaaagaacaatttaaataacactataaaaacagagttatcaggagagggagtggtggctaccgatatttaccattttttcttggtggggatttataggaatagaatacagtcagttcctctatttatttatttttgtttgtttgtttaaacccgttgctgttgtgtcattaagaatgtaaaataatgagatagcttttttcttttttcttttttttttcttttgaacaagtctcactcttttgcctaggctggagtgcagtggtgcgatctcagctcactgcaacctccgcctcccaggttcaagcaattctcctgcctcagcctcctgagtagctgggactagaggcatgtgccaccacacctgactaatttttgtatttttagtagagatggggtttcaccatgttggccaggttggtcttgaactcctgacctcaagtgatccacctgccttggcctcccagagtgctgggattacagacatgagccactgcacccagcccaaggtaactcttaataaatacagcaatagctcagggtacttacatctgagtgtgttctgctgttcctgaaataaattaacatatgcatagtaaactctaaagttatcaccatttgggtacatagaagtttactgaggaaagaagtttagtgtctgtcatataaacagcattattatccttggtaatgtctgaagtatacagccaaagttgagaaagtttttgaactaataaaaatatattttcattgattatgagagtgaaattggtacatgtgtaatttatatatatataaagtacacaagttatctatatatagtttgtatacttaaggaaattgaaaatttaagaaattgaaaatctactactttttagtactttttaggtttctttccagttctaagtgagtgtgactttgtataactgcattgtagtatgttctcctctatgcaaaaataaacaagtaaataaaacccagtgttatatccttgacgaggacactattttgttgctgacatatggttagtcatgagttgtattcagtaccataccttcctcatttagcagcaccatctgttaaaactatggctgataccagtagagaggaagccaattatttttgagtttgtgagcatgggataaatgcgaatatgtctgaagttgcccgcagtcaaatcctttacaactggtgtagtcaaacaattggaggtagtgctaccttggggaaccaggtcaggaaagaacatgataatgcttgttcggcatctttctctactcttagcaagggtgatgtgttataaaattaaataacacataattaagttattaaaaagatttgcatgatatgctttgtttttaaggctctcaaactattggtgtttgtggtttgtgactgcagctggcataataagagttggtaaaggtcttttcacaatgaggcaaaacctttacaggaatgattttcttcataggctttttatggatttgggagagtattgtactaataaagttaagcatgaagttattagacatttatcattgatttcatgtctgtgtctttatctgtgttacgaatgctttggactgcacatatgggaatatagcagaataactggccttggagggacattgggtttttcaaaacagacctcttatctgtgtgtgtgctggcagcaagtatgtatttttcgatttccacctggactcttggagcacctttttattttcttcttctttcttccttcttccttccttcttcttcctccttccttcctcctccttctcctccttctccttcttctccttctcctcctcctcctcccccctcctctctccctcctccctctcttttccctccttctcctcccttcttctccttctccttcttcttcttcttcttcttcttcttcttttttttttttgagatggaatctcactctgtcacccaggctagaatgcagtggcacagtctcgactcactgcagcctccgtctcccaggttcaagtgattctcctgcctcagcctcccgagtagctaggattacaggtgtgcaccaccacgcccagctaatttttgtatttttagtagagatggggtttcaccatgttgttcaggctggtctcaaattcctgacttcaagtgatctgcccaccttggcctcccaaagtttattattattattcatcttaatgttctccttaatattgggaccatattctgctaaatgaagcatggtatatatgatttttcctttttctagaggtttatctttggaaaattttattttcttttaacttttatttttacttcaggggtacaagtgcaggtttgttacataggtaaacttgtgtcatgagggttcgttgtacagattacttcatcacaggtattaagcccagtatccgttagttatttttcctgatcgtctccctcctcctgccctccatcctctaataagccccagtgtgcgttgttcccctctatgtgtccatgtgttctcatcatttagctcccacttataagagaacatgcagtatttggttttctgttcctgtgtcaagtttgctaaggataatggcctccatctccatccatgtccctgcaaaggacatgatctcattcttttttagggctgtgtagtattccatggtgtgtatataccacattttctttattcagtctcccattgatggacatttaggttgattccgtgtctttgctattgtgaatagtgctacaaagaatatacacttgcatgtgtctttataataaaacagtttatatttccatggatatctgcccagtaatgggattgctgggttgaatggtatttctgtctttaggtctttgaggaatcgccatacagtattccatagtggctgaactaatttacattcccaccaacattgtataagcttttcctttttctccccaaccttgccagcatctgttattttttgactttaataatagctgttctgactggtgtggaaaacgtttttttttctttttttttgaagtagtgacaactttgaaattatatttggctctgtttttgcccagtcttccctctcctcttccctcatgcacaaacttaccataggaccaataacccatatcaggccagactttcccttccctcactttccctccttttctcttattttcctttctgtaagtaaatcttatccaaaacaggaaacaaacattaataaaatataaaaggcagggagacaatggcaacaaaattctactttaggctagaatctaattcttgagtaattctttcagaaaagatctgggtggtaaattctctgtgctcttgcacaactgaacatgtttcatacttgttggaatgagtctagtttttgaaactttaaaatattttttagagacaggatcttgaacttgggctcatgtgatcctcctgtcttagcctcctgaatagcttggactacaggtgcacaccaccacgcctgactagaatgggtctaaatgtttagattcaaagtcattttccctcacagctttgaggcattccttcctttagaatttattctaatagttaagaaatctggtggccatctgttttctttctctgcaggcatcttttgtttttcatttttcaaaaacttttaggcctttatttttagccttagtcatctaaatatcagaaggacattcctggtgtgaatgtctattcagctacttcatgcttagggctctagggattctgtcaatctgaggtttcgtgtcttagccctggaaaggttttaagtttgtccttaatttccataccttcattttctttatgttctccatttctggcaatcctgttatatgtgtcagcttttgtggactggtcctttgtgcagtgatccacctgcctcagcctcacaaagtgctgggattacagatgattttaaagtgatggtgttatttttcaggaggctaactctattattggtatatgatagatggggaagattttacctgtgacccagaatgaacatgtttgttatgtatttcagtttaaaattaataatgtgtgtgaccaagacactggtgtttactattactgttatgctcttggataaagctaagaatattaaaacttgaaaaaattaatacataatatgttacatatttgtgggtacgtgtaatattttgttatgtgcatacaatgtgtaatgattgagtcaatatttggggtgttcattgccatgaatatttatcatttctgtgtactgggaacatgtcaggtcctctcttctagttgtatatttgaaatatacaatatattgttgctgtctgtagtcaccctactcggctatcaaacattagaacctattctttctatctaactgtatgtttgtacctattaaccagtctctcgttatccctcctagtccttggcacatccccttcccacttgcgatatctattattctattctctacctccatgaggtcaacatttttagcccccacatgagtgacaacatgcaaaatttgtctttctttgcctggtttatttcacttaatgtaatgatttccagttccattcatgttgctgcaaatgatatgattttgttctttctttatggccaaatagcattccattgtatatatgtaccacattttctttatccatttttctgtgacagacacttaggttgatttcatagctttgctattgtgagtagtgctgcagtgaacatggaagtgcaggtatccttttgataaactgatttttttttcctttggataaatacccgttagtgggattgctggatcatatggtagttctatttgtagttttttgagaaatctcaatactgttttccataatggttgtactaatttacattaccaccaacagtgaacaagagttcccttttctctgcatccttataagcacctgttattttttgtctttttaatagtagccattctaactggggtgagatgatatctcattgtggttttgctttacatttccctgatgattagtgatgttgagcatttttccatatacctgttgtccatttgtatgtttcgttttgagaaatgtctattcacatactttgcctgtttcttaattagattttttttttgctgttgagttccttatatattccgcttattaattctttgtcagaggaatagcttgctaatattttcttcctttttgtaggttgtctcctcactttgttcctggttttcttgctgtgcagaagctttttagcttgatgtaaaaccatttgtctacttttggttttgttgtctgtgcttttgaggtcttaatgataaaatctttgcctagaccaatgtcctggagtgttttccctatgtaaaatcacttttttgaatggataatttgttgaatggcacaaaattcaaagggaaccaaaacccatacagtaagtaataagactccatccatctgccgtctgcttcagctaagtatttgtgaagaaactcattgttgcaatttctacacacacacacacacacacacacacacacacacacacacacacacacacacacaaagggtatggatttataagaataaatgtacacacacacacatatatatatacatacataatgttttttgctttctccttttacataaaagttagcatataatacacatgattttcatttaactatttaggttgttgcagaagtaattgcagctaatatatgatttggttaccttgttttatcagttcatcacaaaatttctttctttttttttttttttttttttttttttttttttttttttttttgagacggagtctcgctctgtcacccaggctagagtgcagtggcgtgatctcagctcactgcaacctccgccttccaggttcaagtgattctcgtgtcttggcctcccaagtagctgggattacaagcatgtgccaccatacccggctgatttttgtatttttagtagagacagggtttcaccatgttggccaggctcgtatcaaattcctagtctcaagtgacctgccctcctcggccttccgaagtgctgagattacatgtgtgagccaccatgcctggctgcgacaaagtttcttattttattttttgaagtagtagtatattccattttgaggatatgggatatttatatacagtaaatatttatatatttatatataatatatattatttagccattccttttattctagacatttttgttgtttcttttcttggcttttgctaataacaaaactgctacagtgatacccatgtctttgtatttatgtatcattttgcatatgcataaatatatttttagactatctggaagtgtaattactgggttaaaagttgtgtacatttctaattttgatagatattacctaattgccttgtgtagagattatattaatttatgctcccatcaacaacatatatgcttgctggtttccccagaaccttgccaacatagttctatgtatcatgagttttttttgatctttgcccatctgatgaatgaaaaatgggatctcagtgtcttttagtttgcatttcttacaagggtgattttttgtttcattttctgtgacctgtctgtatccctttatcatttttctgttgggtgacgcttactgatttgtaggtactctctatttgggaaatcaacccttcatgatatgatttccagatttttccccctttgctatatttttatgttgtttatggttgctcttgccatgaagaaaataattactttttacatagttcactttatcagtgttttcttttactccaaggtgatgatggtaattctctgattgtttctgctgttactttaatggtttcattttcttacatttaaatctttgagttacatgaaatttattttgatttatgcatcattgatggttccagctctccttcccctggatgactagccatttctcctgataccatttattaatttatcttttctcctttaattcgaatgcatctaccaaaagctaacttactaaatgtatttgtattccttctctcatatttaagagttatgtttgttcagtatgaaaaagttcaaacgtacccacaagtagagggaatagctcagcaagacccccctacttatcacagattcagtaattaagatttatctttttttccttttacttatgtttttgctgaagaattttaaagcaatcccagataacatgtcatttgcctcttagtagttctgcgtgtagctttaaaaatatggactttcaaaagataatcaaatatttgactttttttgtttattatactttaagttttagggtacatgtgcacattgtgcaggttagttacatatgtatacatgtgccatgctgatgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgctaaaattttctcccattttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaagaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtactagtaccatgctgttttggttactgtagccttgtagtatagtttgaagtcaggtagtgtgatgcctccagctttgttcatttggcctaggattgccttggcgatgcgggctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatatttgactttttatggccaggagcagtggctcatgcctgtaatcccagcactttgggaggctgaggtgggcagatcatttagcccaggagttcgagaccagcctggacagcatggcgaaaccccgactctaccacacacacacacacacacacacacacacacacacacacacactacaaaaattagctggacatgatggtgtgcacctgtagttttagttactttagaggcttaggctggagaatcacctgagtgcacgaagttgaggctgcagtgagctgtgattgcaccactgcactccaggctgggtgagtgaaacctttctgtctcagaagaaaaaaaaaaaagcctttttgttctaaattaaagagaaaaaccacggggggcttaatagttgatgtctgtgcttttactggtactcagttgctgaaggtggtatcatattagtcctttaattgcttagagttgtgtcctcatgaaactttctccctgaacttgcttttaagggagatctgcctctgtatgccatggtattggaatgttttattagtgtagaagtgtctagatgattttcctagggggccacttaatgagcagtctgtgtgtaggccctatgaataataaaattgtgatcagtggttaagtatagccaaatgtatggataggacctagggaataataaagaagtgcttcaaatgtagcttaaaactatttttttttaaattttactttaagttctagggtacatgtgcacaacgtgcaggtttgttacatagatatacatgtgccatgttggtgtgctgcacctgttaactggtcatttacattagatatttctcctaatgttatccctccccctgtcctccaccccatgacaggccctggtgtgtgatgttccccaccctatgtctgagtgttcttattgttcaattcccacctgtgagtgagaacatgcggtgtttggttttctgtctttgtggtagtttgcttagaatgatggtttccagattcatctatgtccctgcaaaggacatgagctcatcattttttatggctgcatagtattccgtggtgtatatgtgccacattttcttaatctggtctatcattgaaggacatttgggttggttccaagtctttgctattgtgaatagtgccgcaataaacatacatgtacatgtgtctttatagcagtatgatttataatcctctgagtatatactcagtaatgggatcgctgggtcaaacaatatctccagttctagatccttgaggaatcgccacactgtcttccacaatggttgaactagtttatactcccaccaacggtgtaaaagtgttctatttctccacatcctctctggcatctgttgtttcctgactttttaatgatcgccattctaactgctgtgagatggtatctccttgtggttttgatttgcatttctctgatggccagtgatgatgagcattttttcatgtgtctgttggctgcataaacgtcttcttttgagaagtgtccgttcatatcctttgcccaccttttgatggggttgtttttttcttgtaaatttgtttaaattctttgtatattctggatattagccctttgtcagatgggtagattgcaaaaattttctcccattctgtaggtttcctgttcactctgatggtagtttcttttgctctgcagaagctctttagtttaattagatcccatttgtcaattttggcttttgttgccattgcttttgctgttttagtcgtgaagtccttgcccatgcctatgtcctgaatgatattgcctaatctatttttgaaagtgtgcataaggcttaatgctagaaattggtaacattttgatcaaattcatgactgcattcttgagaataagcgtgtccaggcatattccctatttgattccagaattataccactaagatttgtgctcagttttcattttatcaattcttttcgttttttttttggatacagggtcttgctctgtcacccaggctggagtgtagtggcgcagtcttggctcactctagcctcgacttcccaggctcagctgatcctcctgcctcagcctcctgagtagctaggaccacaggcacgtgccaccacacctacctaatttttgtattttttgtggagatgaggttttgtcatgttgcctgggctggtcttgaactcctgagctcaagcagtccaccctccttggcctcccaaagtgctgggattacaggggtgagccattgcacctggtgattttttcagtttcatatgagaaaatatacttctatgatagtgacaggtacaaatattttacatagctataaatttcagtttagattatatttgtcaattggattccatggatattatctttcctttctgtttaaactatttaaagctaagctaccctcatatcacttgttattgataattcagatgtatcctcagatttgtactccaaaggcaacttcagaaacttaaaacatggttcagactcttgtgcatctataaaattcttttgaaaaatagaaagccagaggttgcaaggctttagttaggagtaaattcaggagaaccattgtacaacatggtgacaatagttaacaatatatcgtattcttgaaaaatgctaagagagtggatgtaaaagtgttcttatcacaaaaataactatgtgaggtaatgcatacatcaattaactagatttagtcattctgcaatgtatataggcttctaaacattatgttgtatgtgataaatacaattctatcttctagttaaaaaaaatgagaaattatttttgccaaatagccctaataatcaccagatagtcaccaaataccttgcagcaatataaaataaatgcagattttggttatcatttgtatcattcatatatccaatttgactggcaattcttccttttctgaacaaatttcaaccccttaattttctccagtttcatggtgtgtctatgccttgctacaacctgctgaatctcatacatatttgactggttaggtcttccagagccctgcagttccaaaaaagatttaatgaggcacttgtttgtgaattcactagccagtcatttgattaaattaaaatgaaatttctgtgtttcgcttttctatattttaaatatccccctattttctatatgtattcaagtgacttggaaaggttatagcaccatctcttaatgaaggatttttgtggaaagctaactcacacctctcttctttgacttgaataaactgttgtaatctacttttgtctgttttgttcaatataggtaaattatctgtgcaagcgaactcacgtttagagagaatttctcagttttcttcccgtagattctcagtcctattattagttcatatgtgttggttaagtggtaaaacaaggcttgggctgaaagccttattttccacatatacagagccatagcttatactggagaaaagaaaagtcaccttaatcttttggagggaaatgatgaaatctggaatagtcataaccaaacaatgtatatttaacaagatagctcaaagactttctatttttataaatttaacattcttttagaatgattgaatttagaattattgaaaatagcataaattcttaaagaatttaaatgtttgtgccatttgttaagcttctacaatatgctggatctgctcttgtgactttgcatatatcatctttaatcttcacaacgaatctgcaaaataaatattatccacataagatagatgagaaaggtgaagctccagaggttaagtatcttggctaatgccacacagctaatatatgatggagtgaggatttgaagctacatttctgaatataatgctctttcttacttctggacatttgatagtatttgttgaatgcttgaaagatgagaagactagcacacttgtttactgggtctatatttcctgcctgtctaacaccgaattttttttttttctggaagaaaacttttggcttcctaataggtgcatttttttctgttaataattttattttttcaacacttttaaagaaaaattgaataggtagtatggaatgctcctataggtgcctctctttccctgccatagcttctcctattatttacatcttatattagtacggtatgtttgttacaattaatgaaccaatattaatacattattattgaagtccatggtttgtttttatctaatgtcccttttcttttccaggatgccatccaggacaccatattacatttacttgtcatgtctccttagggtcctcttgctgtgacagtttctcagactttattttttttcccctaaagcctttccactctaccttactgctgcctcagatttaccatttgcatttaagtacaattgtaatttgttactgattaccttgagattttttggtggtggtttttcaaagagctttgctactacataccttgacatttttaaggaatccaggtgtccaggttattatgtattctaggatgttcctctgttagaatatatgtagtgtttttctcatgattagcctgggatatgggttattgggaggaagaccatgcaagtgtgctgccattttcaccacatcatatcctgggtatgtattgtcaacacgatttatgactgttggtgttaacctgaaacctggtagaagtagtgcttgtcagttttctccactgtgaagtttactcttttcttccctcccttccatactggaagtcattacatgagcttgcactgaaggagtcggggggttgtgctcccccttttttagagtggtgtatctacataatttatttggaattcttctacacaggagatttgtgtcttctcctgcatttattaatttattcaatcatttatatcactgtggagacatagatatttattttatactttgagttataattcaatactactttatttattttgttacttaaattgatctagctttggccattgggagatgaccctgtcagtcacttccgtgtcagtcgctcctgtgtccctttgcatacctcagtgtttttttttttgaccactttttggcactgcaagatgctctgggctcatcttgcatatttcctgccccagtcttaaaatcagccatttctccaagaagccttgattccttttattgaagagtagtgttagaaaccaacatctggtgctgggtgtgcttattactgaggtgtcatttcttttaaactctcccagtgtcagggaaaaatgtgtatatactaatctttagatataatacatatataaaaatatttctatatgtgtctctatgaagttaaacatgagttcttactgatgtttccagctctaatttattacaactcctaatatttaagtgattttaagaacactttttaagtttatggcagctttattctttacctttttcttttgtttagctttgcttctatatttaggtggactctattcactctcagttgtgtcgtataaggacttctcaattcttgaattgttttaattcttccttgggctgcctaattttttatacacaagtttcccctaccccaaggaaaaaattcttcatggttactatattttctaatttcttacttgtatgtttgaaaattgtattaaaaaaactaaggattggatcctatcagtgagatatttgagaattatatctgttcaccttttaattttcacagtattgctttctgattttggatggatatattagacaaaggggatggagagtagtgttggattgatactgaaatgtttttagttttgcctactctgcttctagatgacagtgttcaaaagcttatagtttcagtttgggtcccttcccaagttaagaacactgttgatgttgttctttgcttattttatttcttgtgtttagttcattgggttcagagagatacaggttcagtgattctgtattgttctgccatctttacacttgatcttagccaaaaggccgagaagtgatattctgctatcttttactttgaccaatattttctttcccctaaagcctttccactctactgcctcctcaagtttaccatttacatttaagtacagttgtaatatctagttgctatctttgctgttatctagtacaactctcattttatagatgaaggagcttaattgattatcatttgcattagaaactgacacactaattttttccccctaattgtctcaaacaaaagggaaactacttttctttgtcaggcttttttcaataaagtatttttatgtctaagcatatttgtggtgactaattatattgtttttgtatggattttttggggaagaaaaatgtacattaaaagtcttctgttagtaagataatgaaagataaatctttgtatttccaaggcaaagcaagcataacttctcttcaaacagattgttttggtcaaatttggttgttgcagaaagcccattcatttttttagtaacaacagataaagagcttaactaaagttgtgatgaaaatacatatacttatttgagaagactggtaatttttgaaaagtcttaagataatcagtataaaagccaactttttaagcaaagaaagtaaactattaagtttatgcaatgattcattttggatatttggaataggatatgacattattatataacatagtttgtcagcttagacttattttgtagcacttaagtgattcagtgttttaagggatttaaaatgtgatcctttacaatacactttcccaaaatcagtgaggaaaggaaattgctatgttatgttcaaatcttgttaaaatcttattgctatagtttacagaagaggtatagtgattttaaaaatatttatgcagtgcaaatgcttgctgtatatgttttacaaagtgaatcaaagttggagggtagttatttaataggggaatatttgttggttcctaagtcatggtttctgaaataaagaaaaatagcagtatgcagtagacctttattttattatcagtctattttgatgtgcttttaatagcactggtgattaaagttgcagagtctggagccagactgttaagttcaaatcagtgttccactatttgtaatgtttggccttggcttacttaagcccaggttcttcatctgtaaagtggggctaatcatgtacttgccttgtagaatccttataaagattgagtgaatttatgcatgtaaatctctttgatcctggcacagagaatatgctcaataaatgatagctatggttatatttttttaaaggagtatgggtttattatttatgtgttttctttgaaggactgataacctttgacatgaggcttattgtagagttcttttcttggtattagatcttgtgcagtttgggagagtttactatttaattcaagcagtttgttttcaaaatttatgagcagacatttggtggtttggagtgactacaaggatgaggaagtataaacagagataggtagtcagttcttggtagatacctttttctttttttaaaaacacttgagaaatactatttagaactgagacccatgtagacagccaccaccatactgttcatcattagccataccattccccatcattagttaaggaaatgcattcgatttttaagttttttcccccctttctgtgctgtctttttttctctcctgaggatgcttcttgtatctttgcttctgacttgagggcaggccaggcagataataagtgtatagctgctgcaccattttatatacatgtgaaggtcctgcttttgatgtaattgggtctctgcttctcttcaccttaatgttcttaacaacttgctaccaccatgagccccacaaactcatatgacttggtatgatctcactgattagatctgatggtagaattaatttaaaaccacccatttttacaattgacgagagtagtgggaaaaaaaaactgtggcatgaacattgagaagcatttcaaattccatgtagatggcatgctactcaattttttacataagcttctgtatttaattttgtataagaacaaatgcctgcggagtatatagaggccaaatttttgtttgtttgagtttactatattcacatcaacaactggaattagggtaggctgtagaatagaaatatcctcttggtaataatgcagcaaaattctgtctgtaaggcttttatgctttttggcacaggtcatatgattgtggtttaggaaatatactcacctcctctcttcatctgttttctgagtcctaatgtgatttcccagaatacctagcacatataattcaaaaagacaatatttgtctttgctctggttgcagtaagataaaactctgaagaattctgggttaagatgttacagaaagttaatttccaggaaaaattactctattggagaaggtatagctctttctaagagtattccatagatgagactggtatctgtttttgtaactctattcttacatattctattccacttcagcaaacttcttttgagtagatgataaaactcttaaattttttacctgggtgctcttatctatcaaatataaaaaagcctttagagaaaaatgtattggtgacttcaaatagtttagtcaatacgcatccattttgcatttttggtgttggttagttgaagaagaatttcaatggtgtgtgttagtcttgtgtggctctcatagttaccgcctgggcagtatgtggaattcactaaatgaattgaaaagttctgaatatctctttaacttatgacaaatccctgaaaatcagtgctttctgatgagtcaaactatataggtagtatataaaaagtcaacatatgctatacgggacagtttaataagcatttagagtatttggctcaaatgtgttctgtgtactttaatcctcttctgtgatttgtaatatttagatccattttccctattgggttaggtggaaataaggcattgacagtcaatgaattgcttttgggtagagctcaacataaaacagattttgctgtagtaaagattatagattatcatcttagaagaaaatgtagactgttatgtgaaaaaaaatggccagattttgtaagattgtaattgggaaactctgcacccctttgaccaattttaacttattactctttcttactagcttaggcttaaaacaataatgctgtctgcaagatctgcctttcttgtgatccccccatccccagccattaaattctaactaggatctatgttttcttctctggagttacttttggtgggtggtggagggtcccacggatgtgaataagttcactttcccctacttcttttattttgtaattattttacttctaagttcacttttgttacatttttttcttccttgactcactgagttagagttagtctcattgttcagaagccctcttcctttataacttctttttttccaatgcctctgttatatgcagaacttaccttcattgcctcataaatattggtgttaggagacatcatccctcatctgtctcattttgcaaataagcttcctgctagaaagttggctagatggaagcagagaccttcactaaaaccttgatcctcctctgttttcccagcacatagtaggtactcaaaaatacatgttgaatgagagaaaggaaatgagatccagagaggctaagtgaagtaatatatgagaatatataacatgtaatgtcatgaatatatgttatgaaagtactaaaaggctccagaaatgttagttatttgttgttagtattagtgtaatagtaaattaccattaataatattttaaaacttattactagatgatatagagatacttttcattgtatgtaacagaatacccaatcgatagtgacttaaactaatgaggattcatttttacattttgagggtagatatctgccaacattgacttagctgctctgtaatggcagggctattgttctgtaattttcttggcctttccttacttgttgcaagatggctgcttctgctgtaggcatcacctttctgtttgaagcaccaggaaagggcatggatcaacaacagcatctctgttttaccagggaaccaaaagccttcctggaagctgtgtagtacaacagtcttccccttaagtcttatggccagactgtttcacatggccacctctatctggaaggaaggctgtgaaagggagttggcttttctagcctctactgtagacggggaagggagaaggagtttggaaatacattctgggtttgctgcaaaatctacctcttcggctagcccaaatccgaatatatccttcttatgaatacattttatagagaattcagtcaccatctctcccggggagatgatacctgttcttatacataattgcatctacttcaaagtccagaatgtctgcttgatacatagttttctccatcaggtctagttgtagcttgttgtcctctggtgacctagaactaagaagacaaatatatacttccagcacatcaaaaactactagataaaggaatgagataactcaaataaatcttttcctttagaaaaggggagaattagaaactcaaaatagtcattggtccacaaatataccatactctgtaggataagaatattgaagatttcctgttgtggcagtgagtgaaattccttaaacaatctgctatacttatttatgatccctgggaggtttcccttggtcacatctgaccagaaagtattgattggtgtagctgtataataagtcaggtagaccagttccttccacattattcttttccgaattgttttggctattttaaggacttcccctttccatataaattttagaataagtttgtttatgcctactgagaaccttgctaggatttttgataggaattacgttaaagttatatatcaatttgagaagaattgatatctttactatgttgagtgttccaatccatgaatttgataagttcctctgataatttggagagactttaattttttcaacacaattttataatttttagcatgtagatcctgtgtatgttttgttagctatacacctaagtatttcattttctttggcacaaagaagtataattggaatggcatttgccttttaaaatttgtttcatttgctgttagtatacaaaggtcatgatttttgtttgtcaatcttaaattctgtgaccttgcagaagtcactttattctaggagttttttgttgttgttgttgtaaattccttgggattttctagatagacaatcatattatctgtgaaaagagacagttttatttgttcatttccaatctatatgcattttatttccttttcttgcttcattttcctggctataatttcttgtactatgttgagtatgagtggtgagggtggtcatccctaccttgttcctaatcttagggagaaagaatttgtctttcaatgagtaagtctgatgttacctctgggattttttggtagatgctctttatgtgtttgaggtaaatcttgtctagttctagtttttttgagtgtttttaccttgaataggtgttggatactttgtagatattaaaaatactatgaagggagactggattattcttttttagctggaaatagagtagtatgtgaattagaatgataaagtctgactgttgtctcaggcatacaatacttaaggcaccaaagacattaactggctctgaatcaacttcatgtatttctctatttagggaaagatttattaacataattacatgtgactattctttcttattttggcttttaaaatagatgttcctttaacataaacatttttaaaaagcatactttgtcagtatctttgtcggttctgccactgatattgttcccataaaaccaacccttattttactttcagggaaaaaaaaaatacttcatgtggttaaagaatcatgttgtatgttttatagtgccttccatgctcttgcaattttccagtgacagctatatattcttacattgcagagcagcctgcctctttagtcttcgtttcaaaataaaaccaaaaagaagaaaaaattacagaaatgttgttaagaatagtacaaaacccttttttttttgttttttgccttctgagtcatttgatagtgagctgtttacttgatgccccatcatccccaaatactttattgtgtgtttcctataaaattattctcctacgcaactacgacaaagccatcagcaacagggaaataacacttaggcattaccaccacctaatcctcagacttcattcatcttattcccttaatgtcctttatggcaaaagaaaggattccctttgaaatgtctctttaagatttctttaatctggactagtttctctctctttacttgcctttatatctttgacattttttgaagagtacaggccagttacttgagtgattgtgtcttgatttggctttctctgatgttttctcatgagtaggttcaagttatacatctttggcgggaagatcttcagaaatgatgctttttttctctctcagtgcatcttatcaagtaacacctgactttgatttgtcctattattggtgatgttaactttgatcagttgattaaggtggtgtctgccaggtttctccactgtaaggttattttttcctcttcgcagttaaatgtattttgtgaggaggttctttgaggctatgtaaatttccccttcctcttcaaactttcacccctcttgaattcctgtgctctgcaccttgctgtccctctataggaatgcccttttcaccctttctggttctaacacccagcaaagaggctcttctgaacctgcacaggccatcctgctgcctgggagtgatacctgcctcactccatttctgctctcctgcccaatatggatgcccttttcacctcctggtctttgacaccccaggccaggctgccttgtcatgcagatgcccatcccattgtgccgcagctctgtcaccctgtgctggttgccccctgtagagatgccccatgttcttcttgggctctgagaccctgtgctgggctgcctgtcttggtggatgctcttaccctgctcatacttttttattttttatttttgagatagagtcttgccctgttgccaggctggagtgcagcggcacgatcttggatcactgcagcctctgcctcctggattcaagcgattctcttctctcagcctccttagtagctgggactatgggcacccaccaccacacctggctaatttttgtatttttaggtagagatttgtatttttagatagagtttcaccatgttggccatgctggtctcaaactcctgacctcaagtgatctgcctgcctcggcctcccaaagtgctgggattacaggtgtgagccaccacgccacgtccctgctcagactttgataccttatgccaaactgcccctctttgtggccagcccagccctccttgtgtctctggcattgatagcccatattgattcaccctcccatacagaggccttcctcatcctgtgtgtgccctgacaccctcttccccttggatgggctctgatcacgtttcctaaggctgctctctgccttcccccagctcagccacctgcttttatcagtcccacctattgtctttatgctgaatttgtctagaagggtagggaggtaaaaggaactgcagtccctcttggtattcttaatcagccccctgttgtttgctttttcacctttttttttttctaccttttcatgaagagtggttagagataatttataacatttgaaatgtaaaattattttcttagaaaaaaccaggtgactataatcctttgaataaatgtgcaaagcctgatgattttggatattttcaaagaaataatccctgaatattggagtgaagacatcccatatcacagtacctaatgtcagatggcaaatagctagcatggaatcagcttgcttcagttcagcctgtagagccaaagatccatcctggcactgccttctggtttccagcttaagacacctctttgcaagtcacaacatctctttctatttctgtttccgcatccataagatgggggttataaatacttaggtcatggggttgttggggagctcagatgagataatgcatttgaaaatgcaagtgggaaaatgctatgcaaatgtggttatttagttctaatttattacctagtcaaaattgaaatgtataggaaattaagtcaagcattttaattgcacttgtgatttgtaggcaaattccctctgagtcataaggcagataaaaggtcggcatggttttgtttttgctgccacttttaagtccattgtgttgtcactattactcaaccaggtaaacactcctcttttgaagttctgcccacctgttacgcctctgtgacatactgccaccttctagatgatttttacctctggtgtacaactgtcctccctaccccagtgcctgttttctgtcatctttggtgacatcagcttcattggccttaacatgagttctttcatgcatctacaatagcttgtggcacagttctgcttgcatatatcactggttagggatctcaaagtgaacatgtctaatgatcaagttacactcttctcccctgacctgctcctccctagagcttccatttatgttactggtgtcactctttgtattagccttgtagattggaaacttttaactcttccctctgtcatctcccatgtctagtcagtcagtaagttcttttatttttgcaaccatctcttctccacttgagcatctatttccccataattaatggtgtattcctttaaatctaatctctgaactcttaaaatagccttcttcaaggcaaatgttagaacctcagcttgccaggtcccagactggtcctctgctgaataattggatgaaaaagaccatggggcctaagtcacttctctgagtcagcccttccggatgaaccagtcagatgttacaggacatgtctccagagacctgtaaaaacctctagatggtagggttcaggcttggggaagaagacttaccatgttaggcccaaactcgtgcctggaagcatctagaatctgaaaggacctgttctgtatagcatgaattccagtatctaaatatagcaactgtaaacattttggtgcattttcttttattttttcttttgcatgtctataattatactgtatgtgttcattcatcacatctgttaaatgaaaacattttaatgatattttagtaagtgcatttttaaaattggtgtgtaacacggatgccccttgacttaggatggggttacatcctggcaaagtgaaaattcatatgttggaaatgtgcttaatacacccaacctactgaacatcatagcttagcccatcctctcttaaatgtgcttgtacacttaaattagcctataattgggcaaaatcatctggcaaaacagtccactgtagattattagttgtttaccttcttgatcgtgtggctgactgggagcagtggttcattgcccagcatctcgagagagcgttgtagtgcatatcactggcctgaaaaagatgaaaattcaaaatttgacacatgggctctactgaatgtatattacttttgcaccattgtaaggttgaaaaattataagtcgaatcattgtaagttggagaccatctttgcttcagagaatgaaagattgctatccatgtttctgttagaacaagaagatcccttccaagaaataccagactctctgtcagagcttaaccccagcttctgctgagagtgtttgtttagtgttaatttttgattgctgacaactagtctgtttttctcctacctcggtcatgatgcctactcattaagttacctttctgctttcttggtctcgcttatttgttcattcatgtatttattcttttattattcattctccaataataatagcatagtctcttctatctcctgagtttggctctgaagacttaaagattgcttagttcatcgagggactatttatttttgaatcgttgccaggatgtaccacgggcccatctgtgggcacatagaaagcagtgccttcctttctgaagagagtagagaaagcttcctgggggaggtgacgtgtacactgctctatgaaagatgagtagcaggagttggttagggcagacaggtggaagatacatttaggcagtgggcacagaaatgagaacagtggtgatggtgtggctccagcttacctctaggtttttgtttttgtttttgttttttaacagctgtattgagataataattcctatgccatgaaattcactcatttgaaatacacagttttcatagagtcaatttaaaacattttcaataccacacaaagacactccacatcctttagctgagcccactcagtcctcctatccctctcagccctaggcaatcaccagtctactttctgtgctgtggatttgtctcttctggacatgcgtttgaggtagaatcagacaacctatgttcttttgtgcctgacctctttcacttacataatgttttcaagattcgcctatgttgtgtgtatcagcacttcatttcttttgattgctgaataatattccattgcataaatataccacattttatttatccatttatcacttgatggacattgggttgtttctgctttttggctattaggaataatgctgttattaacattgatgtacaagtttttatgtgaacacgttttcatttttctggggtatatacttaggagaggaattgctagattatatgttaactctctgtttaacaatttgaggaattgccagattattttccaaagcagccaaaccattttacattttgattaggagcatatgagggttccagttcacgtccttgccaacagttactacttttaaaaaagtatagccatcctagtagatgtgaagtgctatctcattgtggttttaatttgtatttccccaatggctagtgatgttgagcctcttttcatgtgattgttggctatttatatgtctttggagaaatgtctattcagatctcttgcccatttttaaattggattgtctttttgttattgagttgtgatagtattttctttttaattatgaaattggtagttgttttgaccaagtaagtttgctaggtcaaaatctagaagtggttcttatattggagataatattctgcagattaatctaaagatctcttttaagatgtctctttaaaattctatactctagaattggtgccgatcctggaaatgtaccattctgagcagatgacttgtgttattgatttgtgccaaacaactaagggttgtgtataatctgaatggaaagcagatgttttggcagtttgctagtgagtggttttctcttggttagggcctgctcctttactaaatagaactattttcagtgtatcacttttcaaatatttgaataaggaaggagatttttgggggacatacaaatttatggatacaattgaattttttgaacaactttattattttatgtgtagtaaattctcaataacgacttattttctttttcatcaaaataaatgtttaactagctgcaaatagtatgtatcttattgacccagttttcaattatgcatatgtacagattatctatgactattaaaacaaactcttgctttctagtttgttgctagttccctgaattgccttaatggaaaccatagggagaaaggagattattgcaatggtccaggtgtgacatgatggcttatacaagagtggtggtggtagtagtgataagtagcaggtgtatttcacattattttggagataaaatacattgggaattgttggatttgccatggaagatggtgaggggaaaggaatgattaaacatgattccagcaaggtgtggtggctcatgcctgtaatcccagcactttgggaggacgaggcaggaggatcacctgaggtcaggagtttgagaccagcctgaccaacatggtgaaaccccgtctctactaaaaatacaaaattagccaggtatggtggctcatgcctgtaatcccagctacttgggaggctgaggcaggagaatcgcttgaacctgggaggtagaggttgcagtgagccaagactgcaccattgtactccagtctgggcaacaagagcaaaaccccgtctcaaaaaaaaaaaaaaaaaaaaagaagaaagaaaaaaaggatgattcctagggttctggtttcaccatttggggagatgtgccatttatggaactgtagaacactggaagaagtgaggtttagtcatttgcttattaggtctcaaatccaattctctgaccctctcagtcctgttttgtattgcatttcataggtatccttaccatttggcttttgtgagtagatctggacaattggaggcactgatggaagactggagggtaggagtagggagaaggtagggtatttttctccctccctttttactccgggtggtgtcccaggaagtggcagtttcattcctgtggcttcagctgtcagggagctccttccttcctttgtagtccctggtcccaaagggcaactcctgctattctagcccctgtcaaatgatcccagctattgggctcttataatacaggttgagtattttttattcaaatgcttaggaccagaagtgtttttgattttggattttttttttccagattttggaatatttgcattatacacttactggttgagcgtccctaatccaaagatccaaaatgttgaatttcctttgagcatcctgcggttactcaaaaagtttcagattttggagcattttgaatttcagagttttggattagggatactcaacctgtaccacctcttctagtgggtctccccagcccttaggctggtagtagcttcctgctgggaaaagggaggaaagattttcctctatcctcttagggtctttggctgagtctgaaaatcaaattgccaaagacagattaacagaagaaaaacattcaaatttatttaagttttatgtgacatgggaactttcacaaggaaatgaagacccaaagaaacaggtaaactttagtattttttatagtaggtttgaagaagagtggagagccatggagaaatatggtagggtaaaagagtgtgatctaatggtagtaaactgggggaaacatagtaggacctgattttgccagattcttctgtgtcccctcgtcttcagagataaggatgttcctttcctctgggtatagggagggcatgtctcagatgagggtcttacaacctgcttcaggggaaggtcagaaattttcttctaggttttatgacttgtttcaggggagacaagagggacaaggtcagagagaccttcctgcttctgctatttttcagatctcttccatttaaaatactcactatgtcgaggtggtatattttggggtagtgtgctctgagccccatcactgctgttgttcattttggtgttccttcccattccctgtttggagtcttggatcttctattgccatgtaaccacatttctctgttaatttgtatctgttttaatgcttagagtggtttcttttttcctaactagaacctgatgaatacagggtgaaaatttgagagttcaattttggaaattatttgtgtcaagtttagtatttctgtgatgcattccagtgatgttcttaggtgagttggatagtgagctcagatgcgtgtgtgaactagaagtataaatttggctatcatctcagccaaatggtagtatttcaaaccatgggagggatggatgggatcatctagtacacagaagagaagggaatccaaatctaggtcctctgaaactccgagtcctgagaggtgggatgggggagggagatggataaagtagaaaggccagggagagtgatgctgttgataacataaagaaaggattgttggcggggtgaagtggcccatgcctgtaatcccacactttgggaggccgaggcgggtggatcatctgaggtcaggagttcgagaccagcctggccaacatggtgaaaccccgtctctactaaaaatacaaaaattagccaggtatggtggtgtatgcctgtaatcccagctactcgggaggctgagactggagaattgcttgaacccgggaagcagaagttgcagtgagcggaaatcgcaccactgcactccagcctgggtgacagagtgagactccgtctcaaaaaaaaaaaaaaaagaaaaaagaaaaaagaaaggactgtttcactgctttgtgcattctgccaaatgtttatggtgtcagttaccttgatgaaagcagttttagggacacggtgggtagttgagggtcttcaccaaaatgaagtggtagatgagtgaatgtgaggtgacagagtatagctcgtgcatagagagagttctttcgagatgtttgataatgaagggggagtaaacaaatgaggaaggccgggcacagtggctcacacctgtaatctcagcactctgggaggccgaggcgggaggatcacttgaggtcaggagttcaagaccagcctggccaatatggtgaaaccccacctcaactaaaaatacaaaaattagccgggtgtggtggcgggtgcctgtagtcccacctactcgggaggctgaggcaggagaatcgcttgaacctgggaggcagaggttgcactgagccaagactgtgccactgcactccagcctgggcaacagagcgaaactctgtctcaacaacaacaaaaaagaaatgaggagatagcaggaagatgtattaagaaaagctacagtttttatgattgccttttactttaaaaatatttaatttttagaatagtttctaaatgaaagtagaagtcatacaaggaaaagttttcctcttctttcccattaactcttttttactcccttctcccagccccagcatatagccactgctgtgtgtttctggtatacatccaaaaaaattttatgtaaataccagcaaatgtgattatatattctagattttccccttcttatccctagggatagcctactgtatatatttttattgtcttatttttttttctctgaataatatgacctggagatctttctgcattggaacttagaggttattcatttgtttataggaatatttgttctgaaggtactaaaatatttgtaaccagtcattttttacgattacaaataatacctgtatgtttgcagtaggctaacttcttaaaaggtgaactgctaggtctgagaatatgcacctgccatttcagtagatactgtcatattacctccttaagtggcgatctggtatctatgcccaccagcaaagcatgaagagtactgttttctcacagttacatcagtatagtgtgctatcaaacttttggatttttgacagtctagtaagtgaaaaatagtattttttttaaaaagtgcagttttagttttcatttgttaagaatgaagttgaacatctctttgtatgttcaagaaccatatgtgtttcattttttcatgaactctcagttcatatttgttgcccgtttttttctattagctttggtcttttaagtttttgagttttgtatgttaggcctaagggcctgacagctcactgtggctgtaacattgcttgtaagatgggcctggtgagcagtagttttggattggggcatggtggctggatcgtgaagggccctggaaagtccatttggtgtttatataggctcttggtttataaaactttttttgacttacagaaatagtatcttattagagattctttttttttttttttgagacggagtctcactctgtctccaggctggagtgcagtggcgcgatctcagctcactgcaacctccaactccctggttcaagcgattctcctcccaagtatctgggattacaaacgcgcgccaccataagtatctgggattacaaacacgcgccaccatgcccagctaatttttgtatttttagtagagacggggtttcaccatgttggtcatgatggtctcgatctcttgacatcatgatccgcctgcctcggcctcctaaagtgctaggattataggcatgaaccaccgcgcccggcctagggattctctagatgcagtaacttctgaaataattatatgtcaaaatcaatagagcaatttaatttggaatgaggatggggaatattaataatgttcttttctacatggtaagtacaacgtctgtcttgtacctgatttgactatgaccaggcctacttagctatggggtaatagccataattaattttcaatagttactggtagagctttgccagctattatttttcatttaaaagaaaaaatcgtctttcatataatgaacagacttcaagttgacccttggtttcctcatcttatttctatgaagcactcagggggactattttaagagaacaaactcattatataagtaatctccgagaataactgcttcttcctagtagcttctatttcctttagtcagagactcactctacagacaccaccaccatacaaagggccagttcatactcttgagagtttcagaatgggagcataggtactctttgtcagtgtcttcctatcatttctcctctactctttcctccttttcccccctttttctgctcgttctcccagcgctccaaccctagctggcttaaaggaaaatactttatcatgaatcacttttattctttttagaaaacagattttgaaaacatggttactccatgctgagcattgtgtaagtccaaataaagaaaaataaatgaaatgtaaagaaaaaaattaatctattgaccagaatttttattttgttttctttttgttttttgagttggagtctcgctctgctgctcaggctggagtgccgtggtgcgatctcggctcactgcaacctccgcctcccatgttcaagtgattcttctgcctcagcctcccgagtagctgggattacaggcatgtgccaccacgcccaactaatttttgtatttttagtagagatggggtttcaccatgttggtgaagctggtcttgaactcctgacctcgtgatccgcccgccttggcctcccagagtgctgggattacaggcgcgagccaccgcgccgaccattttcattggttttaagaagttatttttcaagttgtaccttaagggtgctttcgaattctcttattaaagcatactctattctcagtttttagtaggcagtcaatgatttgtgttacgtaaataaaccctctgggtatgggtaaacgtactgcacacttaaaatgtttggacttgacttgtcttccagagttctgtggtaaagaaactctcaaaacatgctttttgggttcaagacaatcaaactgttttctctctttgttttgttcttactgaatttttatttgtatcaacctccataccctccttacttaaatccatgaatagactccttttattgttttgtgttgtttcttgggttgattttcaaatggaactgttgtgtaagataaaggtttgttctcctgaatagtgttgatgtgaaccgtgctgtctcttctataatgccaccattatgcagaagcctgcagggggaagggcagattcgtagttgtgagagtctgcctgtgctttagggtaataatcctgcattcattattaatctccctttgcttccatgtctcctgctcattaccaaaggccaagacatgacatgttcaagatcttagaaattttgaaaatagcagaacggctgcttttgaagcccgattgttagtcttagaaatgacaactgtaaggccatgtaatattacttattttagtttttagatattgtctacattgttttttgatcaataggcaaagagccactaatgagccattataatttccttaaattcacagtctctggagtcagtttgtctgggtttgtaatccctgccaaccctctcaccgtgtgattctaggcaagttacttttcttttctagaccttaggttcctcctctataaaattggaataaaaatgaaggtcaacgtgggaggattacatgaaaaaatgaatgtgacaggccaagtttattgctggatatataataggtactcaataatgttagctattatcgttattactaatcagatttttattaccctggatttaaaaataatttttctgtatataaagaaatagtttggaaagtaaagtgtttcaattacaacaatagtttatttcttttgttggtgactattattttcttggttcggtgagtccaaaagcttttagcaggcaagggaaaagtcccttggaaaatgtatatcaggtcactgtttttctgatggatcacagcaggaaaatagtttatgttctcaccttaaaataaaaggaagctattgattccaagctgtatggaaagggaaacttaaaaacatttaaaaagcgttgataagttttttaagggaaaaaagggcaatgcatgcttttaacaattcaaacagtacagatagatataaattaaatattcatgtgtcccttctcaggattaagcattaaaaaattataaaagtagtatccatgcaagtttaaaaaaaaagagaaagaatataaaagatgcacatgaatacaatattggagcccactgaacctttatcttgccttcaagggcaaaccagtttttcatgtatacttctatccattttctttgcttagaacagaatttcccttttttctttttcctttgtaaaacacaaagtagatactagacatattcttctacaccttgctttgtttcttctgataatatcacagagattgttacaaattggcacgtagagatttatgttgctttctaaacaggcatgatatttcagctgcagtcccgtaatttatttaaccagtgtcgttatagtggatatgttggctttttatgttttttgccttgtcaataatcttcaatgagaattacttatttatatatgtttgtgtgtgtgcgtgcgtgtgtgtacacatgtgtatgggtatgtgatgtaagtatcctacaagcacatgtaggagaaattctgacgtgcatatatatttgctagttttttctactttgccttccaaagagtttcatcagcgtagcctgccatcagcagagggagaggttgccagttttcccattcttttgcttgcactggatagtatcgcacttaatattttctattttgatacgagaatataggatctcattttgttttgcattttaaaattatgcgagatcaatgtatatcaggataaattcctaatagatccgagatataaatgcaaaaccatatgtgtattagaagaaaacatgggtgaattacttagtaatttgggaatagaggaagtgttctaataatgactcaaaacccatcagcaataacagaaaagagtgacacatttgctattttagaaataaaaaagtatgaagaaacgataaaaaagtaaaatgacaaactggaaaaaatgttgtgacttctatcatagatatagatagggttgatatcctatgtggcgtatgtgtatgagtaaattaaaatttgagatgaaaataactattagcctgatagaaaaatgggcaaaaaataggtacagatgaaaagatgaaaaacagaaaaaaaaaaaaaaaacactgcgaggggcccttatgcgtgaaaaggtgcccagctcactcataataagaaaaatgcatgttacaccctcactgttgtttttcaccagattggcggaagtccaaagttttcatagcagactccagggtcaaggctgcaggtaaagggcactcacaggccctgctcatgggagtgcaaagtggcacacctttgtggagaagaattttacagtatgtaatggaatttcatgagaatttatcctctgaccccacattcccacctttttggactcgattccaaaagtaatctgggaaacataaaaatgacatgtgtacattgctactcattgcagtactgtttgtaataaagaaagactgtatgccactgccctccagcctgggcgacacagtgagactttgtctcaaacaacaacaacaacaacaacaacaacaacaacaacaacaacaacagactgtaaataataagatattgaaatctagattccatctgtctagcctgaagtttgcagctctccaaaatagatctgatatcccaactttggcattggcaatatttagcttatgtgcagatggttttcagctgcatatcagaggttacgagcactctaaggggttctaacgctcaaatctcgaagtaggtggagttctttcttgggcactctctaagttggtgccttcttcctacctttcccttccctggtccactcttgtccatctgcctggcccttctttccttcagtgcccttctctaatattgcttctccttttaaggcactggaggacctggcatgaatgttctaaggcaagatcagaaggtgttaacctcttagcaggtatttgctctgatgaccagatcatctaaaagtggcagtgtgtttgtatatttattttattatttattccacctccacttatccaaattaatgtatgaaattgggatgtatcttaaaattgataagaacttgcatttaacttctacccctctggaagagtttttgcagagttgatggtgtttctcgtagttgatggcatcttagaagcccaacaatgtgtgcataagggggtaagccatgtggaatcaccattatttattggcaaatagccatagacagttttccttctcacttttcatttttagtgagtttgttttctgtgttatttcataaataaggcctctgctgggtgattgtgggttggctcagagctagcaaatactctaaattgagaaaggaaaagtttagggtattatctttttgttaacaatattaacatttatacagatatctgtcttgaattcttagcatttgacataattaattattccctctttttttcccttctttttttgagacagaatcttgctgtgtagcccaggctggagtgcagtggtgcaatcacagttcactgcaacctctgcctcctgggatcaagcgaatttcctgtctcagcctcctgagtagctgggactataggcatgcgccaccatgcctggctaatttttgtatttttacaaaatacaaagagacaggattttgccacgttggtcaggctggtcttgaactcctgacctcaagtaatttgcccgcctctgcctcctgcagtgctggaattacaggcacaagccaccgtgtctggcctgctttttttttttttttaatttatttttaattttttaaaatcagataggctctttaagactgtaaactccctgagggtagagattctattcacagccgtatccccagtacccagagtacagcctggcacgtagtgaatcctgattgcctattgtttgttgattgactgatttatgcctctaagaggaactatcttttgataatattaaataagatgtcctaatacaaaactgatagagttcagaaataattaagaatctcctggccaggcgtggtggctcacgcctttaatcccagcactttggaaggctgaggtgggcggatcacgagatcaggagattgagaccatcctggctaacatggtgaaaccctgtctctactaaaaatacaaaaaaaaattagccgggtgtgatggcgggtgcctgtagtcccagctactcaggaggctgaggcaggagaatggcgtgaacccgggaggcagagcttgcagtgagccgagatctctagcctgggcaacagagcgagactccgtctcaaaacaaaaacaaaaacaaaaacacaacaaaaaaaagaatctcctatgttcagcgggaaaggaatatttgttgggtgggggggttcctaaaagattatgtaattttttggcattttgacatattcacagaattcctattgattgaggttactgcatcaagtatagtacagtcatgtgttgcttaagcacaggaatttgttctgagaaatgtgtcaggctattttgttatcatgcgaacatcatcaagtgtacccacacaaacctagattgtacagcctatgacatatctaggccattatatggtatagcctattgctcccaggctacacacctgtacagcatattgccgtattgaataccgtaggcactgcagagcatctaaactagaaaaggtacagtaaaaatatggtatgaaaaatttaaaatggtgcacctgtctaagacacttactatgaatggagcttgcaggactggaagttgctctgggtgagtcagtgagtgggtggtgagtgaatgtgaaggcctgggacataccctgcaccctactgtagactttataaacactgtacacttaggctacactaaatttatacaaaatatttttctttcataataataaattaaccttagcttactataatatttttactttatgaaccttttaatttttgaaaacgttttcacactcttgtaataacacttaaaacacaagtatattgtacagctgaacaaaaatatttccttattgtttaagtgtttaaaattaaattttatttacttatggccaggcgcagtggctcacacctgtaatgctagcagtttgggaggccgaggcaggtagatcacgaggtcaagagattgagaccatcctggccaacatgatgaaaccccgtctgtactaaaaatacaaaaagttagccaggtgtggtggcaggtgcctgtagtcccagctacttgggcggctgaggcaggagaatcacttgggcccgggaggcggaggttgcagtgagccgagattgcgccactgtactctagcctggtgacagagtgagactctgtctcaaataaataaataaataaataaataaaaataaataaataattttattttatttatttattttatttttaaaattttatttatttttactttttaaatgtgtttgttaaacgctaagacagaaacatacacatgagcctaggcctacaaagggcaggatcatcaatattactgtcttccagcaacacatcttgtcccactggaagatcttcaggggcaataacatgtatgcagctgtcatctcctatgttagcaatgccttaccttcttctggaatacctgcctcctggaggacctttctgaggctatttcacggttaaattttttttttttttttttttttttgtgagacagagtctcactctgtcacccaggctggagtgcagtggtgcaatctcagctcactgcaacctctgtcccccaggttcaagcaattcttctgcctcagcctcccgagtagctgggattacaggcgcctgctactgcacccggctaatttttgtatttttagtagaaatggggtttcactatcttggtcaggctggtcttgaactgctgacctcgtgatccagccacctcggcctcccaaagtgctgggattacaggtgtgagccactgcacctggccaacttttttctttcttcttcctttttttttttttaaataagtagaaggagtacattaaaatagtgatgaaaagtattctatagtaaatactaagtgataggaatttttaagctccattatactcttgtgtatcaactgtcatatatgtggtccatcgttgactgaaatgtcattatgcaacacatgttttccctttattttgaaaccaatgttggcaaaattccaaagtacaataatttgcattatttattcattgtcatacttcttgaggggtcctatggtaagagttatctagtgacttgaaaatgactgggtagaagaatgtgccaggatataaagctggcatctgatacagatagttcagatggattaggattatctgtcattaggattatttatttattttgagacagagttttgctcttgttgcccaggctggagtatggtggcacgatctcggcttactgcaacctccacctcctgagttcaagcaattcttctgcctcagcctcctgagtagctgggattacaggtgcccgcccccacgcccggctaattttttgtattattagtagagatggggtttcatcatgttggccaggctggtctcgaactcctaacctcaggtgatccacccgcctcggcctcccaaagtgccgggattacaggcgtgagcacctgcacccggcccttatttatttgttttgaaataaactaacaattgctagtttttttttatcattagctagcagacatctgtgacattttcttgtctgcataatatggttctcatagtattgctttgtcatttgaaattcaacattcattcagcaaatatttaaggagtatctcccatgtagcaggccctgtaataagtgctggggatatagttacgagtaaggtgtgagtctcagtcctaaatctttgttaaatacaacagtgaagcttgtttcttgaagctcatttctaacgatcactatggccttccaagctttaggagattggagaagcgccatatgcatgtggtcccacacattgcccctctgtcatcctcccctcaccctttacctacttgcatattgtttagtgtgccgtgacaatttgaatgtctactctgtgcccatcactctgttgggatttgaacgttcaaggagcagcagataaaaatgtattcagtatctcttaaatagtagtaaagacaggccaaaaaatgaatgattttcagtgtacaagaattgtctacacacagtctgttataggaattcagagaagaaagagtactaggatcagattgatagtagaggaatatcactcaggtggcattgggaataatttggaggatactaacaggaggtaggtgaataatcttttctgagttgagtagggaagtgacataattgatttatgttttatataaggcactctggctgctgggtggcaaattagactatggtctgggggtagaggaaatgaatgcaagaaatgagtcaggttagcaaggatcatagtattcagctgataaatagtgtaagtagtttccatgcctttcattgtttcaacattttttttttttagctgggcatggtggtgggcgcctgtaatcccagctactcaggaggctgaggcaggagaatgtcgtgaacccaggagacggaggttgcagtgagcggagatcatgccactgcactccagcctgggtgacagagcgagactctgtctcaaaaaaaaaaaaaatatttttttttgccatgtttataataaaatactgggggaattttttttttttttttagatggagtcttgctccatcgcacaggctggaatgcagtggcataatgatctcggctcactgcaacctctgcctcccgggttcaagcaattctctgcctcagcctcctgaatagctgagagtacaggcatgcccgccaccacacccggctaatttttgtatttttagtagagaccgggtttcaccatcttggcccaactggtcttgaactacggacctcatgatccaccctccacagcctcccaaagtgctgggattacgggagtgagccactgcgcccggtagaattttttggcgtgtgtgccaagttaccagaaactctgatgtgcttaccagtcctcccacctagtgctcttatttgaatctttcttcctaggtggagaatctacacatagacatctgtatgttctcttagttcatgtcatttgatcttagcttctgttcttatacagatactgttgaaggtgctgcagttttcaattttggttttcctttctttatggtaatcctattttaatatataagatcctttcaggcaactgaagtatgcaagaggcaggtggaatagtagcaactttaggtattaaaaattcatataataaatatgatgggtttggattatttgttgcattgccagtgagtttattatagtatataacaatatttaatcaaaatggtgataggaataaaaggcccactttgaggtaaatcattaatttttaaggcagacaagttaggtttttaagaatttctcaagctgaagaatattcagtgtacactctgtgcctgaaaaagcttaacacataatccacaaaggtgaaattgatttgatactcagagttaagattagggcaagtttcactttagtttgtggaaattattagatagtactgtcaagcattgaaagtaaaggaagagaatgcttatcattacattttaagtgaaaagatatagcatagattacacatttttatatttattgttcacaaatatttccatgttctagcaattttctactgtgttgtaattgcctgttcattttactccactgtttttctctcccctaccgcagcaatcccagtgccactggatatttttgaatgattaagtgtgctacttacttcttttttgtgttcatttttttaatagaaaatgcatccgatgcagatttatggctcctgaacagttgcactgtaaaaaacccagctgaagaccactttagaaactcaattaagtaagtagaaattgattttttcctattttgtataatcaaagtaagaattgataccaaaagattagctttttaaaaatgtcaatatagatatttagtttatattaaaaaagtatgagttggacttttaagattatactattttgaatttgtctgatacagaatgatgctttttttattttttatttttaaattaaatttactttaagttctggggtacatgtacaggatgtgcaagtttgttacataggcaaacatgtgccatgatggtttgctgcacctatcaacccatcacctaggtattaagccctatatgcattagctatttatcctgatgctctcccttcccccaccccctaacaggcccaactgtatgttgttcccctccctgtgtccatgtgttctcattgttcagctcccacttgtaagtgagaacatgcagtgtttgtttttctgttcctgtattagtttggtgcggatgacggcttccagctccatctgtgtgcttgcaaaggatgtgatctcatttctttttatggctgcatagtattccatggtgtatatgcaccacaatttctttagtctgtcattgatgggaatttgggttgattccatgtctttgctattgtgaatagtgctgcaatgaacatatgtgtgcatgtatctttttaatagaatgatttatgttccttcggggatatacccagtaatggcattgctggatcaaatggcctttctggttctaggtctttgagaaatcgccacactgtcttccacaatggtttaattaatttacattcccaccaacagtgtaaaagtgttcctatttatccacagcctcgccagcatctgttgtttgttgacttttaataatcgccattctgactggcgtgaaatggtacctcattgtggttttggcttgcatttctctaatgatcagagatgttgaactttttttcatatgtttttttgctgcataaatgtcttttgagaagtgtccatgtgctttgcccactttttaatggggttgtttgttttttttcctatatatctgtttacattccttatagattctggatatcagacctttgttatgtggatagattgcaaaaattttctcccattctataggttgtctgttcactctgatgatagtttcttttgctatgcagaagctctttaattagattccatttgtcaatttttgcttttgtcgaaattgcttttgatgttttcatcatgaaatctttgcctgtgcctatgtcctgaatggtattgcctaggttttcttcttgggtttttgaagttttgggctttacatttaagtctttaatccatcttgagttaatttttgtataaggtataaggaaggggtccagtttcagttttctgcacaaggctagccagttttcccagcaccatttatcaagtagggaatcctctccccattgcttgtttttgtcaggtttgttgaagatcagatggttgtagatgtgcggtcttatttctgagttctctattctgtttccttggtctatgtatctgtttttacaccagtcctatgaagttttggttactgtagccttgtagtatagtttgaagttgggtagcgcgatgcccctagttttgttcttttttcttaggattgtcttggctatatgggctcttttttggtttcatatgaattttaaagtttttttttctaattctatgaagaatgtcaatggtagtttaatgggaatagtattgaatctacaaattactttgggcagtatggccattttcatgatattgattcttcctatccatgagcatggaatgttttaccatttgtttgtttcctctcttatttccttgggcagtggtttgtagttctcctcgaagaggtccttcacttcccttgttagctgttttcctaggtattttattctttttgtggcaattgtaaatgggagttcattcatgatttggctctcagtttgtctattgttgctgtataggaatgcttgtgatttttgcacattgattttatatcctgagagtttactgaagttgcttattaggttaagaagtttttgggctgagacgatggggttttctaggaataggatcatgtcatctgcaaacagagacagtttgacttcctctctttctatttgaatacgctttatttttttctcttgcctgattgccctggccagaacttccaatgctgtgttgaataggagtggtgagagagggcatccttgtcttgtgcccgttttcaaagggaatgcttccagcttttgctcattcagtatgatatgggctgtgggtttgtcataaatggcccttattattttgaggtctgttccatcaatacttagtttattgagagtttttaacatgaagggatgttgaattttattgaagaccttttctgtattgagaaaatcatgtggtttttgtctttagttctgtttatgtgatgaattatgtttattgatttacatatgttgaaccagcctcgcatccagggatgaagcccacttgatcatggtggataagctttttgatgtgctgctggattcggtttgcccagtattttattgaggatttttgcattgatgttcatcatggatattgacctgaagttttctttttttgttgtatctctgccaggttttggtatcaggatgatgctggcctcataaaatgagttaggaagaaatcccttgttttcagttgtttggagtagtttcaggaggatggctttttgaagggttttttgtgtgtctatctccttaagagtaatactttaatgggaacttttctaataagtaatttcagtatttgtgaagttagctaataggtgatttttgagtatttgttaagtgttaactatgtgttcttctcggagaatcaatgcatactttgtgaagttgcctgacacagtccttgcctcttttccctgcccattagcactgttctaagtgctgcagtacctggctttcaacggaattgcactttgttgaagggaggtgggcatattaagtccttgcttctttctttgttccctcaagttaacgtggaagaagtatccttttttcacattttctctgaatcttatctccatggatcttcttagaaaccttcttctagaaattatttcctcattccatatttccaacctctccaactcccctggaaccttttcattggtatttaaacatacctgggtctaatcggccccctgtgcccctgttagctattgtcctacattttttcttgccttcccagccagacttttaaaaattcttctcttcttaatttcattcttatactcattctttttcccctttattggttttattgtgaaatatattaaacatacattagcgtttataaaacacatacagtttaaataataataaacacttaaacatctgccacccagtgtaagaagtataacattgtcaagaccgtagaaactgccgtgttttcaatcataactcccaagaagtaacctttatcttgacttttgtgagtcatttccttacttttattagttaatgtatcatctattaagtatgtctttaaacagtgtgttgtcttgtttagccgtattttgaactttatctgttgaacttatactgtttgtgttcttctgagatttacatctttttctcagcattacgctttgagatttattcatgttaatgggtgtaaattcatagaatttgctacaatttattcattttattattaatagagttttgaatttttcccagtgttttgctttcatggacattcctgctatgactattttaaacatgttttccggtgcacatgtgtaagaattattctagaatatgaacctgggagttgagttactgggtaacatatctgtgtacattcaaactttattaggtaacgccaatttcttttcacgaatggatgtagtagtgtgcattctcaccagtaatggatgtgtgcatttgttgttttccatttttgtcagcacttgatatggccagacttaagtttttgcaagtctgttggtgatgatggtatttcgttttggttttaatttacatttcctttttttcttttcttgagacaggctctcaccctgtcgcccaggctgaagtgcagtggcaggatctcggctcactgcaacctctgcctctcgtgttcaaaggattctcctgcctcagcctcccgggtacctgggatcacaggcgggcgccaccacacccggctaatttttttttttttttgagagggagtctcactctgtcaccagcctggagtgcagtggggcaatcttgtctcgctacaacctccaactcccgggttcaagtgattctcctgcctcagcctctcgagtaggtgggattacaggcgtgcaccaccacacccagctaatttttgtttttagtagagatggagtttcaccatgttggccaggatgatctcaatctcctgacctcgtgatccgcctgcctcggcctcccaaagtgctgggattacagacgtgagccactgcgcctagtcaattttttatatttttagtagagatgcggtttcaccgtgttggccaggctggtcttgaacttctgacttcaagtgatccacccaccttggcctcccaaagtgttgggattacaggcatgagccaccgcgcctagtcagttttttgtatttttagtagagatgtggtttcactgtgttggccaggctgatctcgaacttctgacctcaagtgatccacctgcctcggcctcccaaagtactgggattacaggcgtgagccactgtgcccggcctttgttgcatttctgtgatcattaatgagtttgggctttttaaaatagatctattggctatttggattttacttttttggtaaaatggcttctcaggtcatttgtctatttttctggtttttttttttcattttaatcatttatttgtggccatatattatgtgtcttacatatcctaatccttagatattatacacgttgcaaatatcttctcccaattgtggcttatcttttcattttcttttgtggtatcttttgatgaagataaattctggtttaaagtttattaatccgttctttttggtctgtgttcttattgtttaagaagtcttttcttactctgaagctattaagatattttcctatattttcttctaaaagtttcatggttttaccttttacatttaggtctataattcatctagagttgactgttattattttttattatggtatcagaaggggtccaattttatgtctttctctgtagataaccaattgtttcagtatcatttatttatttaagttctattctttcttcttttatctgtgcattgcccaccctctcatatgttgagtgtccatagatgtttgaatctgttctgggtcctctatttcattcctttgatctatttctttattctggttcttgttctacatagtcataagtagtacagagttacattaaggctacctatttgatagtgctagtacctttttgttcttctttaagagtgtatctgtttttaagttgaacaaggaatactgttgtgtgtttgtgattacatttaatttttagatgattttggggagaattgaatcttcacaattttgagttatccaactcttctatcctgactttttaaggattgattcttttctttctatagctcttgtgcatcttttagacttttttctcccaatgtagatattgaattattccagtgcgttaagaaaataaacttattctttcttcttttgcctgcacagtatgtactttatatttttatactactttaaatggtaaactttaaaaattttttgttttctgtttttactgccttggtcagggacttagttgtagtagcaatgtgaaggatggttgtgtgtaaggaagagtatagatcaggagtccagtgaggacagagtggttgtagtccaggtacagaggatctcatctaaagtggaggtgttcagaattggaaggaatacattgacttgagatggaagaattctttacatcaggggtctccaacccctgggctgtagacgtgtactcgtctgtggcctgttaggaactggctgcacagcaggaagtgagtggtaggcgagcaagcattactgcctgaggtctgcctgctattagatcagcagcagcattagattcttacaggagcacacatcctattgtgaactgtacatgtgagggatctaggttgtgcgctccttataagaatctaaactaatgcttggtgacctgaggtggaacagtttcaccccaacaccacacctcccacccccggtctgtggaaaaattatcttccatgaagccggttcttggtgccaaaaatgttggggggaccgctgctttacacattccacgttgtccaagatgactctaaggtctctggctagaatgaagtgaggaattctaggaagggagttattaagagatgacatgttttggttttgaatgtgctgtatttgaagttacagataaatattttaataagataatgaatatacttgagctttattgagtgtcttctatgtgacgggcagtgttctaagtgctttagatgaattagatattatctagcttaattcttgcagcctatcaatgagttgtagattccatttgtattcctgttttataggtgaagcagcatctgttttacagatgaaggtctctaaggctgctgttcagttcataaatggtagaagtgggattttaaccgaggcagtctgactagagtctgtgcatttaaccattttattactgtgcttcctagataaagatgtcaagtaagtggttgcagaattgaggcagatatcaaagaggtcaacactagaaacacaaatttaatattgtttgcatagagttgatagttgaatgtgatgtcatccttaattcaaaatggtggaaggaacagaggagttcttaccggagcgatggcaagaggcaagggaagggaggatggaagaggggagttagggtcaagtttaggagcagaagaaggacgaattaaactaaggcagagaatggtattcaccagatgctgtccgttttcagagaatgctttttttttttaatgagaagcctgtgattgtctcaaattatgtatttttctctgtagaaaggtaaacaagatacaaagatactttactgctactgataccccctatgtactgaacctagagaatatagtttctgtgattatcaactttataatgtaattaatggacatagttctagagtatttctaaaagtttaaaaactcaaatataacttgtgtcaatgggttttgttatatatgtgttattaatatggttcaaagtaatgaaatgctgtttgaatgattaagtagaaatggcaagaaaagtttgccatttaaacactacaaagctagtggtagcaagcacaggttcctttaatgtactattctgcttgattgaaagaaaatttaaaaagatattatatatgattaagtatttttaatggccttgaagacttttgatcatcacaactaattcttattaagataacacttaaactaacatttgatttctttccagaataaatacaatcctgtaaaaggtacaataacagttaacattgggaaaatatcagattgaggtgacatttatacatataaaatctttcagtgatggattactcttgtcaagcattttgctttattcagatatttttccagttgtcaccattgcctaacacaaaacagcaaagatgagtagtgtaacattgttaaatgttaagtcgtgctacacatgtgccttttctcatcctccagcaccatcctttccctttgctgtcctctcttgcatgcgttttggttttccatgagagtgaggtaaagcttagattcaaagagagcctgataagatgttgcttctccttctgttgcacccaatcctttatacccaaatgtaaagatttacagcagtggggtgggacctgtctttttctaacctggactctttacccatgattgcttcactttgctacttattcctgtgtgtcatcatctctcgatcatctgcttttgttttccttccagtacttcttggtgttaaatagttgttttaaattatgcatcacatcattttgtttctcttgagccaccacacaaaagatcaccttgttttgacaggaataaagaaagatgactctaagggatttactgtctttcatgtgattaatacagtctcaatgattaagatccagaaattgtgcatttgtgacatgacagttatggactgaattattttgtcgtttgttttggggcttaatacttttttcaaggttttacagtgtttgtattattgatattcagactgataaaagagtaagaattttaagtagcaaaaatagagataagagtgactttttggttgccttttcaccttagaaatctgaaatgttattgcccttactaatttagaaagaatcgctaggaagccccctgtgttatgatggcagcctgctggatgcatactagttcctcttgagcatttgtcagttgccctggctttgttttatccattagaccattttgatttagacaatatggcctttaacttgggggggttcttgagtaaataaaaaagatcaaaagtttcaaaaaataaaatttgctcttaatgatagtatcaaatcaaaaaactcctttggttaatgctttatagaagtgtgggatcttttccatgccacctacaggaggtcattcagaggctggtgaaaataaacacatcttgtgtgtcctatataaatgacagaaagaatagccagcttgctttgatcatggactgtcaacctctatttgaccttgtgcattattaacccaaatgggcactgtggtttagccatactgatagtggatagacaggagtcacttgtttttaactgcctttgcctgtagaaataaatggtaatgtcgaagggatggcttaggtatctgaatgtaattacttgaaacgacaattgaaaataaaggcagaactggataaagacaaaaaatgtgtgtttgagacagaggatatctgctttgtataacatcttttcactataggaaagcaccttccatgctattctgttgagcaaaacataaattattggattgttattcctattatgaaaatattgtttatgtagatttatttttgagttctttttcttcataaattgaagttgggggaggtaccagaatattatttcaacttgaacttgtaaagtaaattgctttcaaaaaagctgacttcataagaatagagaagtggttaccttttcagttagtaattatccagtttaaaagaattaaaaaaaaccctttccagttctcttgttaaccacattcactagtaattttcttttttaactaaacttctaaaagttacttttatttactttttgagaccgggtctcgttctgttgctcaggccggagtgcagtagcacgatcacggcttactgtagcctcatcctcctgggccaaagcaattctaccatctcagcctcatgagtagctgggactacaggcatacaccaccacacccagccaatctgttattattattattatttttttttagtagagagggggtcttgctatgttgttcaggctggtcttgaactcctgacctcaatcaagtgatcctcctgccttggcctcccaaagtgttggggattacaggcatgagccaccttgcctgacttccaaaattaatttttaattaaaaaaattttgtcattagaaggtaaaaaatcacagggttttgatttggccttttgtgagaaataagttagatgatgcaagttatttgagttatactttaaataatactatagtttgttgattttttgttaaacttagatattttaattttaactcttctaattatatgaaatggctatagtttagtatcagtttcatctttttgtttaaaatgttagtggcagattcagtgaatcattgtgtgcttttaccagtcacaatctccttttttcagctatccttgcccaccaaaaagtatccttttacatggaaagttagttcaaaatattagactgaattaattagtattattggttgggtattgtctaataagattgtctcccaacagtgctatgcttaatatgaatttacattttcctatcatttgtcatctccttccactgtttggatattgtctgtatgctgatttctcccaaatcttcgtctttgatctgtatatctccttacaggctccagccttgtatatcccactgcttccttgacttcgccatttggatgaccttgaccatggacacctcaaatcatcatgtcagggcctcctccttatctacctcaccttttctctagctagcatttccattagtattgcccatcttctttgattgtggtcatcaggaaattgcattatcatttcttagtgtaacaagggtttttaaaaaaaatttgttcaatgcctctctctcctacctcttttcttgccactgggctatagaattttacttcctccctgacattagaaagtttcccaagcacataatgtatttgcatatgttcttcccttccttggactgtcttctctctttcctccaaatgcatgccctcacctccacccaccccacattaatcccacctggctaaatagttgatctctggaactcatgtcagagataacacctgtggggtcatcgcccttctaagcttcacctcacctcttagctccaaggtctgttccatgctagttctttatcccatattaacaattaacatctgttgttgtgtagtatattctattatttgtttacatatttggcttgctactagattgtgagttttgaggttaggatactgacctcagaaaaattctttttatgaagcctttgacgctctgactctactgtgtaatgattttccttgtcctgggaaacagatatcattaatagacaaagaccatttgtcaacggttgtaagaatgttctcccaaggttgtagtgagtcccttgacagatacaggctgtgtatttgtagaaagggaaaaggacattctaacttcctaatttctaacttctaatattgtattcctgagggaagttgtaaaaggagtatctcccttcttggagtagtcacctggtcatgctggcaggatcttgtgctcctcactatcctaaatgagctccgggccagcttcagggctgtggccattagattagttaaagcatcatgtcttgagtgagagagtaggaaaggtggataaaaacctggttagtgtttggccttgagtttggcacacaattataattactcaatacatgtttgtataattaggttgaactggtttttcctctttttgggaaaagggtttagtatcgttatgctgtcattgcatcaagtcatcgttaatatatttatgttaagtacattgtaagttgtataagtaatataattgcattaatatcagaacacttgtcttacatttgagtttcaaattgtccagatttgagagtgagcaaaatacaccagatataccaccaaaattgaaaaaaaaatcaactgcttgctgttggggaagaagtagtaatgttggaaaggttgacttgatagaggattttgtaagatgagtgaaaaagatctaaaaggacagtgatgtctctgttattgactgaggtatccttggtctctagaatagtgcctgatgaacagcattgagttacttattcactgaattgaattgaaagatttgatgaaggccaaatttctctaaatacattcttgtttatggattaggtcttattatctatcatatgtgaatgaattcattttattcatcttatgtcacagttttgtttagtctattttctgttgttgcgaggattttgtaattttttcctcatgagtttgtttggagttgataatggtatttgaggagcaagttttctagaaacatagatgaagagttttttgtaaagtagggggtgagagttatgtatgttcagagcagcttctgaccatttcctattggaggcttcaagttgtcttctaactctggaaaaacatggagatgagtgagaggaaagacagaatattatcatgtgatgtatgccagtgagcagttttattggaaatacaaaagaaagtctattttagtgtttaattcctggtttacataaaaaaaaaccaaatgaaactgtaaacttacagttaaaagattagtaagttaatttgcaaatcagcaacagaaaaagcagttcagaggtggtaggccattttaaaatgcaaaactgagttttgtagatatccaaaatctttttgaagactagtattttgcatattttatgattaatgttacatcaacagttgctttgtttttgccattttaagcaagagagtgagtgaaagagggcagtgtattatgtgctggcaacagctggctgatagcattgaaatacttacataattaaatatatgtgttggctgttgtcctaacaactctgtaggtggaggctccagaaagcatgcagaaacttgctttagcaggattaaagaaaaaatcaacatgatctaagtctgttctttcagccaagagtgatttcctattgttttggtttgaaagacattctacttattcttggtgtgtgtgtttatataacagcagagaaaaaaaggctcttgtttttttcttcccttattgtttgctctaagagtgacaaacataatctttcataatttttagtcagtagtattgtttaataactgataataagtgaaataaaaaagactttttaaacccataggacatgttaccaaagtattaaatattaaccctttttatttcttacttatggttacacttaggtgtcgttctctgggccacattaatgaagttatttagattgtaggctatattaaggcatagattgctatgatcctgggaaattggataggagtggcaggtaatatgcaacttacttttacctaacagctgtggatctaaatcttactcaaagtgccctatgtttacatattttactgtttttgtagctctaaggctgaggctggtccctactgtacctttgatgaaaggatggcacttttgtgggtgttagagtgcatagacacagtgcagcaccactgtgtgtggctgccccatattaatacctgtcatttctttatctgtctgcacccattttcagagttccttaggggcagccactatatcttttatctgtatcccagcatcttatacagtgattgacagtgatagttgaacaaatgaatgaaccaactcatatgtatgtttcctttgcatgtttatctttcccatcccttccaccttctgtgtctgtcagatcaaatgtcttccactggattttcatagaactttttctgtgtctctttcttattagattttaagagtttgaacttgaggttatctgcatgtcatagaaaacctaaaaagtagaggcttacatgacttaggggatttatttttcgtacatattgcaaagtccacagttaggaaattgctggctttgctttaccagtttaagggtgtgaggattgaagtcggttgttttaaaggtctttcccttttggtgtcaaatggttattgctctctggccatcacatgcactttcccccacaaaaaagatggaagtaccaaactggatgtgccggctgagtctgtcccttctttaaaggagctttataggaagtcccgctcaaaacccgtgcttgcatctcattgtgtggagtcatatcacaggactacctctatttgtaagagaggctgggaaatgtagtgtttttttttcttttgtttttatactgcacacattgttgctcccaacagaattgggattctgttagtaagggagatggggctaatgtttattggcttgatatctctgctatagggtataaactttgggacaagatacacattttatttatctttctatcatttatcaggtccattgtattggaggaggtcctcaacatacttgtgaacaaatgatcctcttttctcctcttatctttattcagaacatttaagaaatgacatagttgacatgtaagaacttttcctctttttgcttactctgagtggtctctgatgaaggaataacagaatacataggagaagttcatggcttagttgttggacacacgtattttttaaaaaatgggacttacatatattttctgctcttaagacctgcaatgaccatatttgaaatggaatctataaggaaaatatgtttttcattgttctgagattcatttctgtgatataataatcataagcctgatttaaaacctagatattttaaaataatttagacataaaacaaaagtggagtttatgatgattatcatggagggtcttaaccaattggaaaacaggttgaaggacagttaaactcattttataattaagcgtttagaaaataatattttgtttaattctaaaaaaatttaggtacagctgaaaaataccacctctcactaagatggaaatttaatgttttagatttcacttgaaaaaaaaatggagaatttgatataaccagtgaaaatctaaccaatgggaagagtcttacaaaacttgctggagattttttataggttggcgccattggatattatcagagggatattaacgctatcaaattctcattccaggatacaacctacacattctgcagcagtgtcttttttgtgtttctgtacacagaaactgtcgagaactacccagatataattaggttctcctgacccattctttactgtttctttgtgtgcatgtgtgctcgcacgctcaatgtagatgcattaagaaagaaactgacagaatcacatgatagaaagtgttttgggaaaaatacaaattaaaatggatgtcaaggatctctttaacaatatgttttagaagtcaacagctcatcctttgtgccaaccaacaatttgctttccagctcataaatttcgtttccattacaagaggaatcagataagcaagtttatggcaaaactaaaaagtttaatttggtgctttccttaagtacctgtcagtattttatgatagttactgaaggaaaagacttgttttacctcaaatgagaaaatggtttgagtcaacatattttgtagtatttcagtcatccatggttgaaacattgattaactcttttgatgcttttaccattttaatttgataacaaaggatttgatgtcattgatcaagtaaattttttaaaaggtaatttttaaaaatagggaatagaactggagtgtattcattgagcaaattctaagaaactttaaaaaattctcttctatctaggctgcaagctttttcttacttgtcatttcagatacttgtatatcgagaaatttgcaatataccaacttggtaatcggtaatgggtggcttgaggggtatacagcataattagaacttaaaactcagagtaatccagggcagatggtggcctgagtatgtattttcgatcccctcattgtcacactgcctaaataactttgaacaaccgtgggagcctttgtacctggtgttagaggggagcacatatgcagctgagactctgggtcttgggcagaagttgtgctgtatagatggggttgggggagtgatcttatctgtattccttgtggtgatggagagaagagtccaggacctagaatctggagagtcttagctctcccatagacctggggcagtgtcttgaaaacttatcagacccagtaatcctcttatataaaaagtgttttgcaacgtaccctttattatactgaagtgaaaatcttgaataatataatctatgcacacacataattaacaaatcaattagcacagtgctctgaatgtgattaatataaggaaaaaaagaaaaaattgttaatgcaatacgtatttcaaaatacaaatgcttaggcacaaatatactagaagacctaatcaaatggcctgtatacagaattacagtgacagtgagagtaatgaatgcagtctgatatgtgtgtagccttaacagcttaaatgccaagaatagcattggtgatctagtgatgcacctttccagaatggatgatgactcttgctaaagttcttaatgacacaaagtatgttcttccttccattttcacagaggttggattcctgaaactgtacaagaaatacttaaaataagtcctcacttaatgtcaatgataagttcttggaaactataattgaaacgatgtatagagagatgagtttttttttttctaagcaatgttataaagaaactgtcgaatgaaacaattttattccaggagctactatatgtaaaatggagataggttctaaggagatattataaatatattttttacgtatatgcatgttaagtggggctttcagaactcatgcaggtcgtgtggaattctctgtacagcatagatctgtgtagcggaagacatctagcacctctgacttcggcctgcttaatggcagttgcacccccccaattagtattatatccaaaaagatttggatttaaccacttactgattaaaatttctatatggcctgaagcacacaaaacaagataaaagaaaaacaggagaatatggatgtgaaggtatatatgacattatgtttataagtttaaataaatactattaaagagctccttacattaggcaacataattagaaaatatccaaagggcataaacaggcaatttatgaaagaggatgtgcaaataaaaatggaaagattttcattcttaccagtgctcagggaaatacagaccaagtgagatattggtttttgcccactagattttttttttttcccagtaggcccagtgctcctgagagtatggggaactgttgtttactctgatacatttctggtagaagtttgaattgctataatcttctgtggaagttgttttttgataggtataaaatttaaaaatatatctgccccttgatttagcagtcctgtgttttatgaccctctcctacagacatgaaatacctgtttgctaggataggaacataaagttatttattgcatgattatttataatgcaaaaagtgttataacaaatcttatgccgtcttaggtattcttctttatgggcacatattaatacattttacagcagctgatcctggaatctacttacatagatttgcccggctgagaagcaacttgagggctgatcgcccgctgcattccaaagaatcctttttttttttttttttgacttattagtgattatgatgacattaccttttattgaactgtttcaaaatacatgaaaccatgctctgatgacatttttgaagtgtctggattctgtttgccactgtttaaagatttaactagttctttctttaattaatatttagctcttctagtatcatcttaccactggaacagcatgtaccatttgcctcatctttccatttcagggctggtcaaaagagacaaatttcagacattaactaactgaacattctttactataatagatttggaacttttatctaaaacaaatgtctatgttctctggccactgtgttaaatatgtatggtgtgtctcttccatttggcagcaaatatccattgcatttgattcagttttcactgcccttgaaataaatatacttgtcctgaatggcaggcttaaggattttccaaagtaaatgatgtttgcaccacatctggccagccatttttatgtgatacattaaagagagtcagtgttcattaatttgacaaatatttcttgaatgcctactatgtgttacaggctttggcaattcaaagattaatgacacagtcactgctcttaggagatgacagtttagcaaaaagggcagagtcttagccagataattataatacagtgagggaagtgtggtaatgcttctttgttgacaatgatacctgaatgggtgcgaatgtacctcagtttttaaaatcctgggtctttttcaagtctatactcatcctgggtctctgtatcttattttacaccccccttccctcaacaataagcaaactttgctatctgaggtaacaagaaatcttgaggaagggcagctccgactttattaattcagttgttcaaagatactatcaaagaccctaggcactaagtacttcgtattttttccttattttttctcttctgccacgttcaatgtgatggcttggtcttcagtgaagttaaaaagttactttcataaggtggctgcctgggttttggggaccatgtgtagaggaacaatttctttcctgtgtgtacttttctggggtaaattttaaatcattttagactaatagcaaaattgtaaaaatagtacactgaatttttgtatactcattacctagatttaacaaatgctaatattttaccatattattttacttttttggtgtatgtgattttcatggctaaaattttaaaacaaaagggtgtgcaatggaaacttcattacagctctgatgttagccaccttatgccctttaccataatgtatacaaatgactatgtcaatacctttcctccctttctcctttgtctctctttcgcttcttctctctcctccctttgtgtttttccctccccctctctttcttccctccctgcctcccttccttcctccaattgtgtatcctggaataattccatatggatatatacaaaggttcctcattctttatagattcatagaatatttgtttgttctcttatttatggatttttagtgttccagtttatgtgcatgaaattttattaaccagtcacctctcgacttttttggtaataattggcattataaatactgcttagaagaatgtttttttaagtatttatttatatttttagagatggagtctctgtctgttgcccaagctggagtggagtggctatttacaggtgcagccatagcatattgcagccttgaaatcctgggctaaagccatctttctgcctcagcctcctgagtagctgggactacaggcatgtgctactgcgccagcttataaacatgttttgactggaaaccttagttgttgactatgtagagtatgtaaacagtttttaacttgtgtcttgaaataataacataattactgaaaagttacaaaaatagtgcaaagacttcccatggacctttcacccagcttcctttaatgtttaaatattttacatagccatgatgcagtgatcaaaccagagaattaatattgatacagacttaattcacattttgtcttttttccagttcaggatccagtttaggattctccattgcatttagttgtcattcactgtcacctccaatctggaacagatcctcatttttttcttcttcttttatgacattgacgctgttgaagaatacttgtcagttgtgttatagaacattggtcagtttgcatttgcttgatatttcttcatggttagattcagatgctatgcattttatcaagaatataggagtggtcgatattgcacttgagattgacaaatatcagtgtgtcataccaagaagattcaggctgttgatatatctctgtaccagttaactttaacatctagtaaccaggtgtaaactttatttaaggtggtagctgtcagttttctccactgtaaagttactgtcttcttctttggaattaatagatattttgggattctttggtactgtgcacatatcctatttctcatcatgctctcaccattataattttagcatcccttggttattcttacctgtaacaatcaatacaattgtattatcaagtggtgatttttctctttccatcatgtcttctccacttattaatttgaatttttgagtgtaaagaagagctacagaatgagtctcttttctctcatttatttatgtattcaattatttatatcagtgtagcctcatggttctttattttttgagacataatccgtaactatcattatcacccatgttgttctggacttggccaatggaaatgtcttcaggttgtctcctttatctttttgttgttgtcgtttgttttcttattgagtgaggattttaatgacaagctatggaactcagcttatactaatgagaatggtacaaggcttgactttccctccgcgcatcttaaccatttttaaatgcagagttcagcagtattaactccattcacactgttacccagtgctcctgtatccttttaatatgcttctgttttgagcacttccttatttcccggcaccataagttcaggcttatcgtgtactttccttgcctcaagtcctggtttgagtcatttcttgaagaagccctggttcctttcactggtgaactgtgtgaagaaaccgcaatctgggcactagatatgctcattgctactaggatgtcattgcttccaggcactcttagtagacttaaatctactaagacttaggaaatgtatgtatttacacaaacacctataactatttctacttatctgtatatgtattaaaaaaacacgaggttgtactcttccctttgattttacttcaactggataggatttgattttagcatctcccttttcttataagtaactctgctctttaacagtgaaaaacagaaagtctcatagtctacaatatatttacattatttgttcaatcctattaatcatatacagtggtttcagaattactaacccatctctgtgaaaaagaaattttactaacacaaatataatatttatgtttagtcctttttgtgaagttcacttgggttagttctttcctttgccactcaaatcaaattctgtttttaatttgtaatacaattagattaatttgttaccacttgtattccattgtggattctccccacttcctggatggttttaattttttgagtttgtgaaatatgagcatggccctcaaagtcagaatgatattaaatcttttactcagagaatgatcactgcccactcgtcctttttgccatccccattactccattctttccatcttgagcccacccgtctcccattagcttttgacttctccttccatttatttatttattttttgtacaaacaggcagaagtcagcagtgatttttcgtattttgatcatgccttctacatttgttaattggaatttcactgtaaggaagagtggtctcttattccccatttattcaattatttatgtcagtgtagactctgattatttattctgtaggtcataatgtcatagaataaatatacagaattctctgtatgaaacccatggaaatttttaaatttccttttgttttttacttaaatgatagcatactatagatactattttactttttgtaatgtaacctgggaactctgcatcagttgatagaaatcttcgtcattctttcttatggctgcttagttttccatgcagtgagtgtatagtggtttattcaactactttcccatgtgtgggtgttgaggttgtctgatatttcacaattccaaactgtgtggcagtgagtgaacttttgcttattgatttttatattattggaggtatatctttgggatgaatttctagagtgcagactgctggattgaaaggtaggtacgattatagatactgcctagttaccctccaaaagggttgtaacactttatatccttaccaccaagtgtgaaaattgtgtgttccttgcaacccctcaaatggaattttattgttgtcattctttataattttcaccattcagtagggaagaaatggtatttcagggttttcatttttcatttctgtaattgtgagtgggtttgagcatcttttatagtttggccatttagatatacttttgtcaatcattcatgtctcttattgtttatctattgtctctcaatttgtgtgagtttttctgtttgtctgtggcatatgtcacaggcatattctccccttttgtctgctgtccttttactttgttgtgcagaatattttattctttgccattaaatttatgaatctttttcaagttcttttggattttgagtcatggctaagttatcacctttgtgtaaaaagaggctaaagagacatttacttttttctagtacttgtcacttacatagtgacatttatatctccaatccttttggagtttattcttatctacggtgtgaagtatgaatctacttttttctttgtgtaacctaattgttctagagctctttttatctctagaaatgttctagtgctcttttattttttttaaatctctaaattttttttagtgatggggtctcgttatattgctcaagctggattgcagtggctgttcacaggtgcaataatggcttactacagccttgagatcatggaccaacatgattctcctgcctctgcctccctagtagctgggactctaggcacacaccaccacacctggtgcttacactagcactatttactaaaaatttagtctttaccaccagtgttttgggatgccatttttgtcaaaacgaatttccaaatttacgtaggtctattttgggctttctgttctgctccacggttctgtttatttgtattccatctacgctgtttgcaaaggaagttttatttatattatagtttgacatctgctagggctagtcctttcttgtagtctgtctcccttcccttccctctccctctccctctccttctgcctctccctctctttctctttctctctctctctttctttccttcctttctttcttcctttctttcttttctttctctttctttctttctttctttctttctttttctttttctttctttctctctctctctctctccctctccctctccctctccgtctctttctctctctgtctctctctctctctttcctttctttcttttctttcttttttgagaatctcactctgtcacccaggctgtagtgcagtggtgcaatcttgactcactgcaacctccacctcccagattcaagcgattcatgtgcctcagcctcccgagtagctgggattactattagccaccatgcctggctaatttctgtatttttaatagagacaggatttcaccatattggccaggtggctggtctcgaactcctggcctcaagtgatctgcccacctgggcctcccgcagtgctgggattacaggtgtgagctaccgtgtctggcctagtttttctttttaaagtgtttttctgagtattctttcatgtgaattttttcaaattaactttagtatcatctgtgtaactccatgaaaaattgacttggtatttgtattggtaaattagaaattaatttttttcttttgagacagagtttcactctgttgcccaggctggactgcaatggcacgatcttggctcactgcagcctctgccccccgggttcaagtgattctcctgcctcagcctcccgagtagctgggattacaggcgcgagctaccatgcccagctaatttttgtgtttttaatggagatggggtttcaccatgttggccaggctggtcttgaactcctgacctcaagtgatccacccgccttggcctcccagagtgctgggattacaggcctgagccacagcgcctggctggaaattaatttttaataaattaatttagggagaactgatagttttaggaggtgaagtccttctgtttaagaatagatgatggcttcacatttattcagctctacttctgtgtcttttagcagtgtcttcatgttttcccagtgtaggctttggatatacagatgtcattccagatctgtgggggattggtccaggattccccaaagataccaagatctgccattgctcaagtgcctgatattaaatgggcgtagtacttgcacataacctatgcatattctcctgtatactttaaatcatctctggattacttgtaatccctaatagtataaatgctagataatacttgttttagtgtattgcttagggaataatgaaaatgaaaagatctgtacatgtttagtacggacacagttgttttcccctgagtatttttgatccatggttggttgaatccatggatacagaacacatgtgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactgtaagtccaataaacctctttcttttgtaaattgcccagtcttgggtatgtctttatcagcagtgtgaaaacagactaatacacgatggatacagataccttgttgtagttattcctttatgttttatgttctttgttgcctttgtaaatatttttttttctgcctttcatagaggatttctctctcattttgacctctaactggttattacttgtatatataaaggctattattcctatatgttcattttatattgtcttactgaacttttttatagtttgagttaatttttatcattcatttttttctagaattatttatggtactctcatttcatttggaaacaagagttttaattctttgctttcaaattcttattctgttatttcttttgtctaatagcagtttcttttgtccagtttgtcttttgtctaattacagtgttgagcagtagtggagatagtggataatcttggcttgttccttgtgttagtggaattgactttagtacgtcccccattaagtaagatactggcttttgcactatatctattttgtcatgttaagaaactatccatacatttctatttttttagagttttttctttttaaaaaatggatacgcagtaaccatacatatttatggagtacatatagatattttagtacatgcatacaatgtgtaatgatcaaatcaggataattagtttattcatcacctcaaacatttatcatttctttgggttgggaacattaaaaatcctctcttctagctattttaaaatatacaatagattagtgttagctatagtcaccctactgtgctgtagaacactagaacttattcctcctgtctaactctgcagcctctttctatcttcttttcccctgctccttcctagcctctggtaaccatgattctactcttcttccattagatcaacttatttagctctcacacatgagtgagaagatgcagcatttgtctttctgtgcctggattatttcacttaacataatgttctccagactcatccatgtatgcctaattgctctgattaggacttcctcttagagttttatcaggtgtgagtggggagttttgttgaaagcatttcagaagattgatggagtgattatttttcctcttacatctattaatatgacatatagtgttagtagattttctaatattgaatttacctcgtgtttctggagtaaatttcatatggttttttttttaaattgttgtattcttggcaaaaaataataaaatattatcatttggggtccatttgtgatatttgtctgtagttatatttttttgaactgtctttttctactttgggcatcagtgttatacttgcttcatttaaagaattagaacatttttattcattttcagcactctggaacaattcacagataattggaactatctggtttttgaagacttagaatttccctgagaacacatctggtccttttgcttttttgtgggatggttcctatataaatttctgtatatgttctttagaaattggtctgtttaagctttctatctctaattggggcaattttggtaatctgtatttctgtatgaaattacccatatcatcttggttttaaatatacagtcatgcgttgcattttcagtcagtgatggactgcatatatgatggtggtttcataagattataatggagctgaaaaattgttatcacctggttatatcatagcaattgtaatgttgtcacacaatgcattactgaagtgtttccggtgttgctggtgtaaacaaacctactgtgctgccaattgtgtaaaagtatagcacgtacaatcgtgtacatacataatacttgatgatgataacaaatgactattttactggtttatgcacttaatatgctaaacttttattattattttagagtgaactgtttctactgattaaaaaaaaaaagttaactgtaaaacagcctcaggcaggtacttcaggagggattccagaggaagtcattgttatcacaggaaatcacagctccaagtgtattattgcccctgaaagtcttctagtggagcaagatgtggaggtggaagacagggatagtgatgatcctgaccctgttcagacctaggctaatgtgtgtgtttgtgtcttcattcttaagaaaaatgttcaaaaggtaaattaaacgttttttaaataaaaaaaggttatggaataaagataaaataaaatatttttgtacacctgaacaatttgtgttttaaggtaatcgttattatgagtcaaaacgttaaaaagaaaaagtttacaaagtaaaaaagttatagtaagctgtttagtttattattgaaatatataatttttaataattttagtgtagtctaaatgtacagtgtttattgtacattttagtgttatgtcctaggccttcacattcactcaacactcacccactgactcacgcagagcaacttttagtcctgcaaactccgttcttggtaagtgccctagacaggtgtaccattttaaaaaagtcggccggcacaatggctcatgcctgtaatcccaacactttgggaggccgatgcgtgcgggtcatgaggtcaggagatcgagaccatcctggctaacatggtgaaaccccatctctactaaaaatacaaaaagttagccaggtgtggtggcaggcgcctgtggtcccagctactcaggaggctgagacaggagaatggtatgaacccgggaggtggagcttgcagtgacccaagattgcgccactgcactccagcctgggtgacagagcgagactctgtcttaaataaataaataaataaataaataaataaataaataaaataaaataaaataaaaaagtcttttatgctgtatttttgtatgtttggatatacaatacttactactgtgttacagttatccacagcatctagtgtagtaacatgctgtatgggtttgtagcctaggagcaatagtctgcaacatataatggcctaggtatatagtaggttataccatctaggtttgtgtaagtacacttgaggaatgatgaaattgcctaatgacgtatttcttggaaagtatctccatcattaagtgacacatgactgtatttgcatagaagtctgcaaaagtgacctcttatgactttaaaataatttcttctgtttttattattatttatgccttgttttttatttgataattttttttgtgtgtgtgtgtgatagagtcttgctctgttgcccaagctggagtgcagtggcgcgattttggctcactgcaacctctgcctcccaggttcaagcgattctcctgcctcagcctccctagtagttgggattacagacacctgccaccaggcctggctaatttttgtattattagtagagatgggctttcacctgttgtcccggctggtcttgaactcccggcctcaggtgatccacctgcctcagcctctcaaagtgttgggattacaggcgtgagccatcgtgcctggctaaatttgttttgttttgtttgtttactttgcttttttcatttttcaacgaaggctttatttttttttagatggagttttactcttgtcgcccaggctggagtgcaatggcacgatcttgcctcattgctgcctccacctcccaggttcaagcgattctcctgcgtcagcctccctagtagctgggattacagtcataccccacaccagggtaatttttgtatttttagtagagacagagtttctccatgttggctagcctggtctcaaactcctgacctcaggtgatctgcccacttcggcctcccaaagtgctgggattacaggtgtgagcccccatgcatggcgagagctaagtctctaatttatcttttattcttgcatttttactgctaagttttagtaatatgaatttttctctgtttactgttttaaatcctagagatgctgatgcatagtgtgctcaatatcactagtttttagaaatcttctaatttaggtttttatttctcctttcacccaaaagctgcttaaatttttttatttctaattttattgcaatgtgatcagagttatttttaatttttctgctttaaagagcttcctgatgtcctttatttgtgatttatcattttgtgaatgttcaatgggtgcttgaaaagaaggtgtattctcttctctgttattaggtagtaacactgaatctagattaagatctgtgttgttttttttttttgactctatttaagtctttgtactatcattgcttgagtcttgtatggagaatgtataggtctgttattgtgaatgcatttcttcttgcagcctcaggttggttttatgttatttggtgcataggtatctatagatgttctaattttattgtcagttgtgtctctaaagtgttcttcttgggctgggcatggaaaaaacaaaagtgcttttcttttcatatttattcaattttggcttggattattctttgtatgttactcctttgtctctttttaattttagtcattctgaattatttagctttaggcatgtttctggtatgtggaatagaattgggtgttgctttgtgaaccacatttaaaatctttttcttttaataggtgagttaagcttctttacagtcagtaaggcttcacttaatgtcctggatagattcttggaaacacagttttaagtgaaatgaattactatatgttgtaggaacttaactcttgctcatatcaattaacctatggtaaattgtttctttatactacagttgtttcgcttaaacttgtggtttccaagaacctattgatggcattaagtgaggacttactgtttgatgtgactacattgtttggtctctgctctgttgtgatgttttaaaattatatatattattttttatttactatgtttctttgtgacatgtgtttttttctttaaataaataaagtgttatttaggaagttgcatattttgagtggttaacttttcatttataacttctaaatgcctgtagtttcattgcctatgtttttgtttttgtttttgagacagggtcttcctcatacccagtctggagtgcagtgtcatgaggcatggttgtagttcattgtaacctgaaactcctgggctcaagggatcttcccacttcagcctccctagtatctatgactacgggagtgtgtcaccacacatggctagatttatttattgattgattgattgtaaagactgggtctcactatgttgccaaggctggcctcaaactcctggcctcaagcaaccctcctcctgccctggcctcccaaagtgttgggattataggcatgagccactgtatccggtttccattgcctgtttaaacatttaccatctactttgtcagtgttcaatagtatccttttattcctgacttttgccaaccaaagaatgtgttttactttctgattttctcaccctacacatttttctgcattatttctatttattataacatttgtacattgacctacttttttcctacttttgtgcattgctacaatgcatagcatttgtacattcatctttggcttttgacaattaatattcccccctgtattttagttttagatctacagttatgtagcaatgagctcattatcagtccttttgctgaaatttccccagacctctcttggttgcatgaagctcatcctgttttatttagattcttcaagaggggattatggattcttgtgtgttaaaaactttttatatagccttgaaacttgaaggataccttggttgtttttaaaattcattattcatacttttattgaatttctaaaaaatgcttttccattgttgcattatattttgttttagacaactctgatgccagttgaatttatttgccttcgttcattattttatcttttatgcctagtagccttggacactttttctttgtttttgaagcctaagggtttattaggatgtgtcttggagttgactgttccaagtaaattctcccaggtactggttgacccttttaatatgcagattcaagttttcttgaattacaatcttaaatattgtttctatttatttttatttcttttttaaaatttttttgctgggactctagttttatcaacgttatttttttcttttttgctttctgattccatcactttctctttgacttttaattttttttaatttttatttttttctgagacaagctcttgctctgttgcccaggttgaagtgtagtggcgtaatcttggtttactacagcctccacctcccaggtcaagtgtttcttgtgcctcagcctcctgaatagctaggattacaggtgcccaccaccatgcctggctaatttttgtgtttttagtagagacggggttttgccatgttggccaggctggtctcgaactcctggcctcaagtgatctgcatgcttcagcctcccaaagtcctgggattccaggcgtgagccaccacacccggtctaattttgttgagttttaaaataatttttatttagaattttatgtaggtgtttttaaacatatgacattatatttgaaatttcttacaaatatttagtaaaggaaggaaaactaaagaagaatttcctgacaataaagcgctgttagcaatgtttgattccttacattcggtgctcaaaccattactattctaggactggtcctttttaaggatggttgaaactaggacagattgtcacttgtctggaattgttctttctataagcaagactttattaatactgaatgttatctccctctgtctctgtctgtgattctcttgaaagtgcttcattctgactgaaggaaaacttttgctttctgcatggagctttgtatagaaacccggcacgacagggcactttcgggtcatgccttgagtcttaagaaatattgaaaaatataatctaacaatgatgcttctgttcagcaaggcaaggaatttataacagggcaaaactgaaacctgtttcttgtttgctagcccataaggaggcagcttgtttttatcatcagtttcctgacatcaggatgtgacttcgagaagaggaaaataacacttattggcatcaaagatactaaagtatttaatgccttaaatgaataatcagtatatgtgaacaatgaaaacacagatgaggaaggatacccagtttcagtttcatctgttgtatcatgttagttggagatatttagcttaagcctcttccctgttggtccactttaccctagttgtttcactgttgtgaatgcatttacaattattttaaaagatggcctcattctgtaggtgaatccctgtaaagaacattgtagaaggttattataacaactcctaagcataagctggagtctaaaatgtttctaggcagcaacagtcatatgtatgcttgacctttgggagatctggttctttcctgttgcttgtttttaccctggcactgtcacccacttgtgcccaggctagtttcaaccactgtttgcctgagcctacattttgtgtttttttccattttagcatgttttacaaatttattgaattacactttgtaccaggtattgtgttagggggcaggtataaaagcagagttctcatctgttatttgataggaaagacagtgtgactgttatcagtttacttattctcagcctgcagcccagccttgtttgccttgccttgggtgacataactggactctgtaatagctgttctttgtcagctgctataatgttagtagatggtcttggtggggaattgcaaagtggtggcagcaggaaagcacttgtcttctgggttccagttttcctccatttttaattcactccagaagcgagagatgggtgcatggaaggcctggtggagctcataggatagtatcgatactgcctcctttcccatgacattacagactgtcttagtttgctcaggctgctcttacaaaataccatagagcaggtgggttataaacgacagaaatttaattctcacaatactggaggctgggaattccaagaataagacgccagcagatttgatgtctagtgagaactcacttcatggttcatagatggcaagttatagctgtgtcctcacacagtggaaggggcaaggcagctagctttatggggtctcatttataagggcactatctcattaatgagggtcccaccctcatgacctaatcacctctcaggagctccatgtcctaatatcacattggtgattatattgtagcatatgaatttgggggggacacaagcattcagacagtaacacaggccatctccctcaagaaaccctggttctagctgtaatagtctgtacttatctgatctgccgttccttctctgcctagatgacatttattaaaatatcttttattatctaacagcacttccctcttgcagtcttccttaaacatcagcctgtattagtctgttctcacactgctataaagacatacctgagactggataatttatggtgaaacgaggtttaattgacccagggttccacagctggtataggaagcatggctggagaggccttaggaaacttacaatcatggcagaaggtgaagaggaagcaggcacaatcttcacatggcagggcaggaggagatgggagtgctacacacttttaaacaatgagatctcgtgataactctatcaggagaacagcaagggggatgtctgcccccatgattcgatcacctcccatcaggcccctcctccaacaacgggaattacaatttgacatgagattttggtggggacacagagtcaaatcatatcacaacccaagttagatttcccaacttgaattcctttaaagcatctgagatttactatagctgtgctattctattagactgcattataatttttagttggcttgtgtttttccttctgaactgtgagctctttttaatttcaatatcactagtgctaagtaacataacctctcagatgcttactgaattgatttaaatcttctatttactttttccttccacttaaaatagtagctcttttctttttctttcttttttttttttttttttagagacagggtcttgctatgttgcctaggcaggagtgcagtgactttcacaggtgcaagcatagcaccctgtagccttgaactcctgggctcaagaagtcctccagcctcagcctcctgagtagctggaactacaggtgcacacactgtgcctgtcttatattttattgagtaatgtgttaggtacttttatatactttgtctagtttaatcccactggagcttaggaaacaagtttagaggagttaagtatcttgcccccatgtttatatagctaggaagttaacatagttcattttaaaacctgggtcattcctgctcctatttatcttctcaaatattcagaagatgttaaaaagtaaccaggtttttggaagatagctattttgtttcttatttttattgtgttaatatagatccattagagtaccagagtaattcagcatttggtttaaaagtcttggctttacttatattgagagattcattagcagaaaattacttattgatagtgtcttatcctcttcaaaatcggaattaacaaaatgattcttttatttctctcacagtgattttttaaaatagattttattttttagagcaggtttagattcacagcaaaattgagaggaaggtacagagatgttccatatatcccctgcccccacatatctgcagcctctcccatgatcagtatcccccatcagaatggtacatttgttacaactgatgaacctacgttgacacatcattatcaatcacccagagaatgtagtttacattaaagttgacttttggtatggtattttctatggattttgacaaatgaataatgacatgtatccaccattattgtatcatacagagtaatttcactgcccttaaaatctttgccctgcttattcatcccaaactcttagcatccactgatgttttgattgtctccactgttttatatttccccagatatcagatagtgggagtcatataatttgtagcttttttggatgggttcctttcacttagtaatatgcacttaagtttcctctatatcttttcgcgtcttgatggcccattttttagtgctgaataatatttcattgtcagaatgtacaacagtttatccattcacttactgaaggacatcttggttgtttctaagttttggcaattatgaataaagctgctttaggccaggtgtgttggctcatgcctgtaatccccgcactttgggaggccaaggtgggtgggtcgcttgaggtcaggagtttgagaccagcctggccaacatggcaaaaccctgtctctactaaaaatacaaaaattagctgggcgtggtggcatgtgcctgtattcccagctacttaggaggctgaggcatgagaatcacttgagtccaggaggcggaggttgcagtgagccaagatcgtgtcactgcactccagccttggtgtcagagtgagtctctgtctcaaacaaagaaaaaatgaataaagctgctataaacattgtgtgcagtttttatatggacataagttgtcaactcttctgggagggcaaaaggaaggtaattgctagatcttttgataagatatgtttagtttcagagtatgttcagattctgtcaaactgtcttccaagtgactgtatcattttgcatttgtatccacaatgaatgagagttcctgttgctccgcatccttgccaacatttggtgttagcagtgttctggatttggccattgtaagaggttcgtagtggtatctcattgctttaatttgcattttcctgatgacatatgatgtggagcatatttttatatgcttatttaccgtttgcatgtcttctttggagaggtgtctgtcaagggctttaccccattttttaatcagattgttttcttattgttgagttttaatatttcttcatgtattttggattatagatctttatcagacatatcttttgcaagtattttctttattgctttttattttcttgacaatatcttttgcagagcaaaattttataattttaatgaaatccagtttattgattcttgtgttcatggagtgtgccttttgtgtaatatctaaaaagtcattgtcaaacctaagggcatctagattttctcctatgttatctcccaggagttctgtagttttatgttttacattgaggtctgagccatttcgatctaatttttgtcaagaatgtaaggtctgtgtttagatttgtttttttagcatgtggatgtccagttgttctaccaccgttttttgaagatggtctttgtaccatcatattgctttcgctccttggtcaaagatccgatgattgtatttttgtgggtctatttctgggctctttgttctgttccattgatctgtttgtctgttctttcatcagtagtacattgtcttgattattgttgctttgcagaaagccttaaagttgagtagtgtcatccttctgactttattcttctcttttaatattatgttggctattctaggtcttttgccttgccatgtaagctttctaatcactttgttgatatccacaaaataacttgctgggattttgatagggattgcattgaatctatagatcaagttggaaagaactgacatttttacaatattgaggcttcctatcctaaatatggaatatctcttcatttatttagttctttgatttcattcattagagtttttttagttttttaaaaaattttattttatttttgctagaaccataggcacacaccatcacagtctgctagttcttaaaacgtttttatagagatgaggtctccctttgttgctcagtctgctcttgaacttctgagttcaagtgatcctctcaccttggcctcccaaagttctaggattacaggcatgagccatcaagcctggctcttgtagtttattttctatagatcatgtacctattttgttagggttattccttcattttgggaggtgctaatgtaaatggtattgttgtaaatttcaaattcctcttgttcattgctggtatttggaaaagcagttgacttttatatattaattatgtatcctgaaaccttgctaaatagcttatttgttttaaggttttttttttttttgccaatactcttgagtgttttatgcagacatttatttcatctgcgaacaaagacagttttgtttcttccttcccaatcaatatacctattatttctttttcttgtcttgtattaactaggacagggtccccaacccctgggccatgaactggtactggtctgtggcttgttaggaaccaggccgcatagcaggaggtgagcggtgggtgagtgagccaagcttcatctgtgtttacagctgctcccccttgcttgcattaccacctgagctccgcctcctgtcagatcaggggcagcattagattctcacaggagcacgaaccctattgggaactgtgcatgtgaggtatccaggttgcctgatgatctgtcactgtctcccatcacccccagatgggaccttgtagttgcaagaaaacaagctcagggctcgcactgattttatattatggtgagttgtgtaactatttcattatatattacaatgtaataatagaaataaagtgcacaataaatgtaatgcgcttgaatcattctgaaaccatctcccacccaatctgtggaaaaattacctttccctcgtgccaaaacggttgggggccactgaactaggacatccagtatgatattgaaaaggagtggtgaggggacatttttgtctttgttcgtgattttagtgggaaagcttcgagtttctcaccgttaagtatgatgttagctatagatttttgtagtctttttaactagttgaagttactctatatctcgttcactgagatcttttatcatgaatgggttttggattttgtcaagtgtgtctgtcaatagatgcagaaaaatctattgctatgattatgtgatttttcttctttagcctgttgatgtgatgaattacattaattgattttcaaatgttgaaccagccatgcaatcagaggtaaatcccagttagtcatggtgtataattctttttatacattgttatatttgattttctatggatgattttatatctatgttcatgataaatattggtcaatagttttcttgtgttgtctttgtgtggttttggtattaggataatgctgacctcagaatgagttaggaagtatttcctcttgattctaatttctgaaaaagttatggaaaattgtcataattaaaaaaaatatggtaacattcaccagtgaaccaatctgggcctggtgctttctgttttagaatgttgctaattattgattcaatttatttaatagatataggcctattcacatcgtctttttcttcttacatgagttttgtagattgtttttcaagatttggttcatttcatctgggttatgaaatttgtgatttgttagatcaatcagggataagaaaattaaaaagttattttacttttattcttttatcaatctttttttcttttctttgtttttcatattttattttattttgttttttgaggtggggtcttactctgtcacacaggctggagtgcatggtcacagctcactgcagcctcgacctcctaggcacgggtgatcctcctgagtaactgggactgtaggcactcaccaccacatgcagctaatttttctatttttggtagagaggggattttgccatgttgcccaggctggtcttgagctcctgggctcaagtgatctgtctgcctctgcctaccatagtgctaggattataggcatgagccaccttgccctgcttctttctctagatccaaatttctgacctacatcatttttatcctatgtaaaggatttttttttttaatttcttgcaaggtagatctactggcaaaaaaatctctcaatttttgtttgtttgagaaagtatttttccttcacttttgaagaatgattttgcgggttacagaattctatgttgttgttttttctttttttttatcaacactttattttactttaccactcgcttgtatggtttctagcagaagtaaaatgtaattcttatctttgcttctgtctagctaagggttattcccccctcaccccccacctctggcttctttcaggtttttttctttatctttgactttctgtagtttgcatatgtcatgcataggtatagtttttttggtttttatcctgcttggcattcacagtctcctgaatcttttgattggtatgtggcataaagttagggaaattttcagtgattactgctctgtatatttctgctgttcctttatcttctacttccgcttctagtattctatcacatgtatgttacaccttttgtaatcatctcattgttcttgaatattctgttgagaggtttctttcgttttttttttgtttttagtcttttttctttgtgcttttcagttttgtacatttctattgtgatatcttcaagctcagagagagtctttgctcagccatgtctagtctactagtaagcttgtctaagtcattcttcatttccgttagtgtttttgatttctcttatatgttttttgttctgttttagaatttctttttgtctgtttacattgcccttcttttcttacatgctgtccattttttccattggcacccatagcatgttaatcattgttgttttaaattcccagtctgataattcccacattctgccatatctgagtctggttctgattcttgctgtctcttcaaattgtctttgatgcttttagtacaccttgcacttttttcttgctatctagacacgaagtactgagaaacagaaactggtataaataggtcttcagtgatgtggtattaaggtgttgggggagagggagtgttctgtaatccactgattaggtctcagtcctttagtaagcctgtgcttactgtgatcctcacaagttcttcttagtcctctccccttcaggagggactagaaagctagacttggctggagctgggcatttgttttcacccaggtcatttaggctctggtgacaccccagcaggttaggctgtagttaactagtttttcctgagagcagactttaagaacagagtactctggtgagtttccatatagtttcttttacctttcccctactggaagcatgaggggattttgctccagtattcactgtgagaaccaggtcaagctcctggaggtaaaaattcacgcaagtatggggccccagtgactgagtcatcctggagtttttaactttactctaaaagttgtccacactgagcctccagcaatacataaattacagtttagattttcctaccctaacactcgttcccgtggaggtttgtggttttctgctcaggcaaattgtgatttttggtatctgccagttggtgtctccaatattaggggcagtgatttgcctggtgacctcaattctcttacatatctaaaaagaatgatttgttagtttgtttagttttttcacttgttggtaggatggaatagcaacttccaagcttctcagatgctgaactggaaacctgaagtccccacaaccatttttaggggcaaaactgtaatgttcatttcatgagtattatatataatttccacctagaggtaaatggtgtttttgttattactggttgttacttgttaaaggtttatgttgtggttttcaaagaaatttcatgtatctgtgctctaattttctttatggaaaaatggaccaaaaaaatagagaggtatttaattgcaatgaatgggtgccatttacccctccctgcaaaaagaacatttcagaatcattcagaattgaatgataagaaattctgtttttattgtataaggcttatggtggtcttagtgttacagaatagctaactttttgaaatttcattgtttgttaatccatggatttttaaaatcattttgcctcccaattatgaaaaataactttcacattgtagaccatttggaaaatacaatttaaaagtcacctgtatctccttgtgtaatggttaccatagttaacatgctagcatatgacttgccaatcttttttctgtattggattctcttttacttacatgaaattatatcgtacatatttttgtatcctactttttaaaaaacacatgtgtttaatgaggtaattttttaaatggctatgtaatatttcattttatggatatactataagttgtatatattttttggctgagtacttagattttatccaattttttattcagtagtataaatgtattataactgtcaaataaatgaacatctttgggtgtaagtctttaccttcttttttggtattgcattttaaaaaatgtagatctagttgatgaaggtggaattttcggtcacagaatgagcattttacgaactccagacatatttttcaacactgttctctagagaagagatatccattagccttactaccgcagtgtgtgagaatgagggagacacacccctgccacttgtgcttttagtatttccaattttagttttgctaatttaatggagattgggatgacagctcattgttttaatatattttctttgattataaacaaaatagaattttttttatatttttttgattatttactatttatattgtctttattatagacttcatgtttttcacgtatacttatatgagtttcttgtatattaagaattagctataagggaactgtggaagtcaagactactttaccatgttcataaaaactgataaaaaatgaatataactttcagatcttgagagcggattttacagatgtcatgtgagttcattgagtaatattcttatgtaccactactgactgcttgggactttattactgtaaataggaaaaacaaaaaattaagattctgatatgctaattattttgcttatatggtggtgaatatacttttaaaatgaaacatgtattgcatgcaacaatactattttggtagatttttagaaaagcaggtattattacaggtaataggcaataatgacttcgaaggtcttagggactatgagtaggtaaacactttatgaccacgaccccacaaacaccccgcaggagattatgtggctgccatttgtaaacggccattcattgtcctgtctcttgcctttggctctttccagtttttcttcccaaatctttggactagttcctgcagaaaatatgaattcacagtggtgccctctgggcctgggcatctctgggccggcagaccctgagcagcgactgctgctgagagcaggtgtgtgtacagatggcatggtggggccagcctgccttctgcttggtgatgttggagagggtgattgataatagagcttacaccgagtaatggtctgaggcaaggcgagcatgagtgcctggctaagtgaaagtcatcgctggcagagtggatatgtacacttaatttagtctgtagttttattaaacttccttattagaggaggccttattttcttattaaccagaggtctccatgctggctgtttcatcttgttgcctcctctcttaccgtgtatcctctcagggaggtgaggataattgagaaagggctaaaaacagctctcccgagtttgagaaggttttcagttgtcaatgcttacataatttagagaggactccaaagcattgtgaaagaaagctcattatgcgtctcagtctccttccttgtcttttcttgtagttgtctccatagtgggatgtacatatccctaggctagatttggagttgggtgagaagaaaatattaaaaacttcatttttatttcattcttttttatttcccattctttttcatttctattttatatatgttatgtaatatacacaaccaatttttctacagtaaagtatgtatataatttataagcaaatatacataaatttggtggtatgcacaaaagtttttaatttttaagttttcgcagtgtgcagtttaaaaattttgtagaacttttgtcttataggatttgttgtataggcatggcagcttttgcttaccctgaatactaagacattttgacatttacataagattactatctaccaattggagtgtttttctcccccctctgagtaaatcaggcttaatagagtacatatgaagggcataaagtcaagggcaattctcactatttctttgccaggattttaaactgaagttaaacatgtcaaaatgactaaagatttagagatgattggtagagaagtgttctcagtttgttactcaacctccaagttaatgtggaattttataactgttttagtcagctttctgttgggagctccaaacatcataaaatcttgtgaattctgcctactactaatcaataagtgaaatgatagtaattatctctggttttcttcatttttatatgctttgacaataatgtttaaaaccattctgggctttgatttgggattccacagaattttcttctgggtcacagagggggttaattatttctagaactctgaaattttgtgattcttgtggttcaaaatcacaaaaaccaaagtgaaatcatggtagaaagcttgatggtggggaatatcagctatggaaagtaacagtaattatcagttttgtactttttttctggaaaatattatcttttgaggcttcatttaatatttttctttatcagcccagaacattaaaaaaaaaccctaacctactggaaaaatttggtaagccagtgctttgagtggtcacaatgtagagaaaatgagcattgtcatgtagtaaagttaaaagacagttgtggccgggtgcggtggctcacacttgtaatcccagcactttgggaggccgaggtgggtggatcacgacgtgaggagatcgagaccatcctggctaacacggtgaaacccaatctctactaaaaaaaaatacaaaaaattagccgggcatggtggcaggtgccaatagtcccagctactcgggaggctgaggcaggagaatggcgtgaacctgggaggcagagcttgcagtgagccgaggttgcgccactgcactccagcctgggcaacaaagcgagactctgtctcaaaaaaaaaaaaaaaaaaaaaaaaaaaagacagttggggcttgcacatgagtaagggacaggatctcagctctctctgtggtgggtggttcttcacagtctaagaaggcctctcacttttttcttccatctttgtttccttttcaaatatttaatgtgtagaaatttttattgccctttctgcttagtcagaaatactaaccattgttgaaacttgtaaccatttctgataatttgcccagttgaaataagataattcttttattcaattccaggactctgaaatcctctgagaccaaacttatagaactgtcagttgtctggactttttgtgtgcattttatcaagagggagaagaacagttactttctcccttccctcaaaacagggcaaatgacagaattctatttccagatagatatgtttctttcagggacaaatgtcctatatttagttctttttagttaatatactttatattagccaatgcctagcactgcacacagcagcagccttgctttctcgcctatggctttctgaaagttgagaccacagaaatacttttgcctttccttgtcatgtcttatccacttaatgagaataactgaagtaatactaaaagctttcataagacctggttaaacttgaccttgagattgcttcactcagaaaagttcttagtttaattaacaagtaactgataggagtcatgcttggcatgggtcttcttgagaacttgccagctactttttttttttttttaagacaagatctctctgtgtcacccaagctggagtgcagtgacatgatcatggctcactgcaacctcgatctcccaggctcagaggatcctcccacttcagcctcccgaggagctgggaccactggcacacactaacacacccggctaactttgtgtgtgtgtgtgtgtgtatgtgtgtgtgtgtgtgtgtgtgtgtgtgtgtatgtaggtggttggtatagaagtgttctcagtttgttacttaacctccaagtttatgtggagttttataactatctttataaacaaacaaacaaacaaacaaacaagcaaacaaacaaacgtattttttgtagagacagggtttcactatgttgcccaggctggatctcaaactcctgggctcaagcagtcctcctgcctcggcctcccaaagtgctgagattacaggcatgagccactgtgcctggcccctgccagttacttttattaaagtcacagtgttctactctggatctagggagaccccctttggttccacagaaggagaagaatgggcatctctacctgtgcatcaggatgtcatttttttgagttgcgtagagaaggttctactcccacagcttgcatattgtccatgtctgtattaatcttgttatgaggcatcaactcagcatgggtaataggtagttacattaatgccagggctcaaggagtcccacccatttctttcaccaaatagcccacgaaagtgatgagagataggatgaccacatatataccgtaaacaccagaatgaaggcctttgtcactgctttccccctcagtgaaaaagtaggaaatgtttttaagtccctgctgttgtttgaatatttgattctccaaacctcatgttgaaatttggttcctaatgttggaggaggggccaaatggaggtgtttgggtcatggtcagtagctccctacagtcctcacagtaatgagtgggttcttgctgtcttagttctggagagagctagtggttaaaaacagcctggtacccccacatctctcttgccctgtgacccctgcacacactgactccccttccccttccaccatgagtgcagattctggtgccatgggccttgtacagcctgcagaactatgaaccaaacaaacctcttttctttataaactacccacattcaactattcctttatagtgacacagactgactgagacagtccctatttaatgcagtgctgctgcttttccagccagcaattctgaaagatgtagatctagtatacatattttaagactgtgtttttctgggaaaaacaagttgtctatggccttatgaactggattttctcatgcttctaaacaaactttagcgctgatgggagtatccagaattatttcctaaaaaatatctagggcttttggtccatcagccactgatagtttattatttgttggatgtctgccatatgtagcctctctttttgttacactcaggggaaggtctcaccatcaaaatcattctttaggactgcttaggttagagatccagctagatgctctggatggacatcattttctcatatcattttatcttttagagaaatacacatcattttctccagatatcaagttataacaggaagaagtgatatttatacattactagagagcttctgcttgttcatgtctggtaattcatttgcaccactagtttcttcatgcttggcatggatctgttcctgctacttccatcattcttttgttttattcctttttttctttggccaggcagatatactctggattgtcagccattctgcagaatgttgaaggcagccattctggtttttattgatttttttgttaattgtagtaaaatatacataatataaaatttaacattttatccatttttaccatttaatcattatttaagcgtatagttcagtgtcaataagtatattcacattgttatgtaaccattaccatgatttgtctgcagagttttttcattatccaaactaaaactctgtacccatgaaacagtaactccccattcctcctttcttccaatccctggtaacgacgattctactttctgcctctctgaatttgactgttccagattcctttatatcagtcgcctttctatttcactgatatttaaaaaatagatttgtaaaagccattgccacatttcttgaatgcatggcttaagttaccagttacatttgcatttcttctcttagctgttgtcccaaaggcattccacattggcctgctaggcataggagagcaaagcatggggagaccccagaaatatgagccctcatccttttaataaagactgattttaagaagtcgtctaaaaaccaagtcaactttcccaccacatttttatattgctcagtggcagttaccaaatagaatttcgtgttactgggcactcctaaggttccagggctccagagcttttagggttagactgtgaacttttgaagaaattaggtagctaagagcacctgaaaatatttagtgaaggaaatgaaatccattctttagaaaaaaattagaagttagcctaacagttagcaaagacaatttcctttggttgtgtaaaactagaatacagactttttattttgaatttctttttatctctgtccatgggtttatgcttggatttgcaacaaacaacaacaaaaaactgtttgtatttttaatagcttttaaaaagtattttaacaaaaatatttaaaattttaccaggtattgctaaaaattaattctttgtaagttgtgttaaattggaaggtagtatggtagaataagaatcacagcttgtaattatatagaatttgaagtaaagctgagtaaatctttcattaactttttacaagtagcctatgaccctgtttgctgctcatttctttccagctttccccagttaggacttgatgcaaacagtatgtgttgaagaatgttttgtatgacgtgttcggtagtcatttttcatcatgttcacttgtaatgaatttcagcattttccacattggctcacgaagattaaaaaaaatcctatgtgttgctttaccacatacttcactactgagtgataatctgacctttgggagcattgctggtcactatatagaatgatatttccttgttctatttcattcaaaatgaaaaaaatcattagagagatgcaaaaggaagaaaattggctgttcttttctagggctggatgtactggaaactacaagatgtcatgcaaaaactagtgtgaagatcctgtaaaacatgactgaaataaactgattttttaaaacaaactttattgagatgagcaaaccattagtatttctaggtaaaatggtttcaaattaaaaaatgcatagagcatcattgttggaaaataatggcttcttaaagttttggtttctgcttttggtgagatgtttgaaatgtcaaggaaattgtatctcctactagttaagattttatctgtttttgaaagataatgtgataataatgtgataatttagatcaaaagagaaggccactttttttgggaacatatacattgtataatttaagcaaaaacttaattaagaaaaaaatcattggtggacttgattttttcaggactctggttcttgattatttttgaggtacagaccattttaataatctgataaaagccatatacatcctgtccaccaaaaggaagcacattcataaacatggcaaaagttttcataccgtttcaattggatttctggaaggccacccatggatgcaaaattagaaaatgtttctgtagggactgtcatgaaatgacataggtaacttttgtcattcataatggttagtttctgccaaacaagtttcagacgagtgagctacttttctacaagactcaggccccattctgctacacaaagatgcctagtaatcattgctatctcctggtatgggtttctgatgagagtgtcctgggctttgtctttttgactgaagtaattgattgcccctagatctgaagtttgagttacgtgcatctcattctttatgcacaagtattttaaagtaactacagacattgtaacaggagataatttatatgctttatatcagtgaggcaccttgttttatacgcaaatccttttaattattttcctaccaatggtgggttttagtcagttttgtgatgttccaatgtattcacattgactttgtcttatggtaaggtttcctgtgtattgcagtgtgtctgtctgtaacatagtggctagtcaatgaattttggttgaatgaacattcaaaatccccactgaacaaaattttagacaacgttttgattttagaataatcttcaacttacagaaaagttgcaaaaaagttgcaaagaaacctcttacccagtttctcactgttgttaaataacatcctacattattatgctacatttctcacaaccaagaaattaacattggtacattcccgttaactcaatgccacattttattcagatttcactagttttcccctaaagtcctttttctgttccagtatttcatccagggtactatgttgcgcttatcatgtcttagtcttctctagtctgtgacagtttctcagattatctttgtttttgatccttggcagttttgggctggtcagctgttttgtagaatgcccctcagtttgggtttgtttgataattttctcatgttgagagttatggacttttgggggaaggccacggtggtgaagtgccattctcatcacagcatatcagggatacctactaaacaactttatttttaatatttcagtatcacaatggagagacgggaagagtaagaaggtaaaatttaaaggagtcagtcttgtcatggtaaaaattgtggtaaagataaggtgagggaactgaatctaaaagaatcatttatatttatctgggggaattcagcccttggtgttcctgtcagtgactcactttgggtgtttaagagttggtagaatttattctatttaaatgatacaaatcagaccaatgaaaaggtcagtggttcatagatacacatcaaggcagaatttacaatgataagttttaaaaactctcttgtataaccatttttttaaagtcagaaaattcttaattgtatttttccccttttcctctgtttctatatatttttcttgacctgtgttcttttgcattaggatttatgtttttcaagtccagttaaggatattgagcaatatgtcaaaacatttgtcacctgaatggtttatcccttaataaatggcgaggtggttttgcagacaggtgacacactttaatgtattacagagaccagacttgttagttattgattcgtgatgaataaattactgccattctaatcataagaaaatttcttttggggataattaatcagattcatgtgcttcttaagcagtgtagcattatcatcttttttagttacaagaatgaacctgtctgcctctgcccttggtaaatttagggcagaggcagacaggtttctaggtttgtattttgatctttatttttattaagcagatgagaagcatactcgcttaaaaattacttcaaactgcctttcctgttgagtaggttttgaactacctgcttgacagatggtgttagaagtaattactgaaatcatgtgtttacctgctcatggacatgtgttcaccagatgcaccctgtttacccagggctgctgatttcttaaagaaatatgcaccttctggatagagttgcataacttaggagaataaaagctcgtcaagccggagctctcaatctctgcatggcagaatcagctgtagcgagaagaccatttacatttcttaatgagtggtcaatttagatcacagaaccatgtacagcattatttacctttcttcttttgatttacttagtagtttaattttacctgtctactgagttatttaacagatagcctcccaaattgttgactaaattgtagcagtagtgactaaccagtcttttaagatgatggtgttttggtttattatgttatttttgaaaacatgtttttcagaagacatattaaaaatgtacccatccctccccgtttctaaattctgattgtggaggtccggcttttggattaggcattttttttttttaacacctcatgagtaattcttatgttcattaagatggagagtagttactttaatattttatttactaactatcaaaactgaatttattttttccaccttgcttctgttttattctgttttttaaaaagttaaactgatgagccaggcatggtggcacatgcctgtaatcccagctactcaggaggctgaggcaggagaatcacttgaacctgggagccggaggttgcggtgagctgagattgcaccattgcactccagcctgggcaacaagagtgaaactccatctcaaaaaaaaaaaaaaaaataaataaaagttaaactgaatgatagtgactcccctaacatgtgtgccttaaatgttcaattttgaaaaggagtacatttaactctctataaacctagagaaacaaggaaagtcattgtttcaggattttgacaggtgcaaaactgtaaataattacaggcctgggcagaaactagaacagaagttgcacagcagctggcaggcctgacctgtgacaggtctgacctgagttaagtagcctaaatttcatggcaagctcagatttgttttatggtatgaaattcaccttctgctacagaaagattctactgattgaggctagatatttgccaaaaagggagtaacatacagaatattgagaaagaaaactgcccactgagccacctcttgtatgacttcaggaccagatggaactagtgtagatgcattttaaaatcaatttacatttggactgaaataaatcactcaacaccaaatggtatacagtggttatagctgaggagggtggtctggaggtttttgggtttttttttttttttacactttttatgtaatctgtttctaaaacattttaatttttagacttaggagcatatctgactttagtgaagaggaaagcagttttaatttaatatcttgcgaatacctgaattgtatttttcaaggtctttgtagagaataatacaaaatttcgatgagattttatcaccttcaggttccattaagcagttctccaccttaggacaccagatttgttcctggtccataaagaagccggctagcagcttccatccccacatgctgtgttgcgaccctggaaagctgcagtttagaaaggatagggttctgatgacttatgggctcaatctcacctatacatgaagttgtttttttttttttttttggcttgcccagtgtcttgaaaatttgacaatttcacattttaaaaaatctgtgtttctagctttcttggaaaaaccgatgaatggcagtgctgggcctgcactgtactattgctggaaccaagtagtagctctctgcttttagactctctgatttgctccagtccttatcattccctgttgtactttcatgtctattaccttcctgtagatacatgagttaatgacccctcgagtagaggatatgtgcctcagaagtggagacatgcagagagaagacagctttcaggaggatgcttgtggaacctttatacagttaggcttggtgtgcccatgtcttctgccccctcccactctgtctaaggtttttccctttttttctacgtaatacctcaattttccccttcaccattagggaaattatacctaccagaactttgagttatgttcccccagccacccttagtaaatatcctatgtacctggtgtgtaggagttttgtgaatgtttactagatctttaatctacccatttgtatgtgtagtttaatcatctagtttttcttcttgtttttagtagaaatcagctttcttgaaggataagagattgattagaaaaggaatggagacatttttaaaggtctgggcagattgagagttagggcagatcctgctgtgatgccgtggtgggagaggctgacagcaatgggatcctttctagcatggacaggaggaagcggaaagatgccagggattaaattttctcagaaaaggagaagaaatgatcctcttcttccttcttttcttccctactcctgtgctgtttggtgtttaaactcttagcactcagtgaaatgggaaaggttcccttgtccccctcgcagggcgtgtgatgtgtgtgtggctcacttcttcagtctcccactgctcgaacctctaggggagcatacagacgggcaggtcgtggggctctgaccccatggcagtgtctaagggtggatgcttacagctcctgaagccccagtaggcgtgtgttacagggtgcttttttagtctttccgtctataggcttgtgttaaccagctgaattagaccctctcccttgtcacaaggacagagggctttctgtatcccggattcttgccttggtgtaccggaagaatcagatcacacctgggcttggggaatgagtgcaaggtttaattgagtggaagtagctttcagcagatgggggagccagaagggagatggttttcttgtggattgggccttccaactgctcaggcaaaacttgtcgttccgccagtcgatggccggctggcctgctggcctgctggtgtctgttgtgtgcccctctggacgtcctctcgatatccagccacctgtgttttcttcgccgatgtgttcctcatgatgtccagccacttgtgtgttggcctgctagggtctcggggtttttataggcacacgatggggtgtggccggccagggtggtcttgggaaatgtaacatttggatgtgaaggcaggagtgcctgtcctcacctaggtctgtgggggtggagccctagccaggggccacgcccttctctacccagcacttcccttcaccacttctttatcatttgaagggaccacgctcttcccttcccagcactcccgtatcactagggtctgtggcagaaataggatttccctttgcttctaattgggtatagagagaagtgaagagctgagtttcatttgtctaagaatctcacaacttactgtaatatggtttccattagaatatgtgttgcaaatatagtgaaacttaaaaacaaaacctccattgtaagttgacttttggcacgtagcttcctcatagcttgggttgttcttggctttgttaaataaagttaaaataaagaaagtggtgtagactggggcttggcaaacaatggccctcaggacaaatctagcctgttgcctgtttttataaataaagttttatcggaacagagttgctctagttaattaaggtactgtttgtgactgcattcacaatattagtgtagagttgagtagttacgatagagactatatggctcacaaaatctaaaatatttattatctggcactttacataaacaattttgctgacctttggtgtagatggttaatatccaaaaaacaaaaaggaaaaaaaaacccaactcttttatgtgctctaatgtatttgctgttgaaaacaaagggaatttgtgattcatttaaaaaatatatatatagctatttgatgattttgaagatattttatagttattgttccatttgaatgaagtaaaaatgttatgatgtcttagggtacaattgagctataattttagtatgtcaatgactacagcttttttctagggaaggttataatagttaacaggaaaatatgacataaatagtaaaaacatgatataatagtaaaaattagtaaaaaatttttgttttgggctgtaagtttttttggagaggagactgtagtaagtgtaaaaacatgatgttatataattagttttacacatattttcaggaatatttttaatacacaaatgtgtggatatagtctattttggtgtgaatttaaactttgaaaactgctaaaagtttcagttacttgagaaatagtgaatttttatttaatgatcaaattaaacactaataaaattatgtctttattgttttcagttttgagagcatttgaaaagtgcaggcctgtgttggggatttcattcaacacaattattgattgtttcaggtattaagcactgtttgaggctctgggatttcagtactgaataaaacaaaatacttaatgagcttatgtgggtagggagagaaacaaacaaacattccttgactcaatttttttatcaaattacaccaagtgcttttttaagacctggggatcgataatagcaatgaaggaagcaaattttctgctgtcatgtagcttaaagaaaggtaacatgtaagtctggtagcaactgttaggaagaaaatgaaagcaaggcattgagagagaagaggggtgtaattttttgtagcgtagtcaaggaagacttctctggtaaaatgatttgagcagggacctgaatgaaataaggtaatgagtaatgggaatatttgagaaaagaacattctagacagaggaaacagcaataaaaaaaacactgggggaggaatgtgcttgtcatgttcaagaaacagcaaggagaggcaagtgtggctggaatagaaagtgccagagggagaatggtaggagatgagtttattttctacttaatgaatagctttgaatatgtatcagaggcaaagccacatgagaccaagctaaattctgtatgaggtgacagcagtataaaaccagaaaacaaggatatatggaagaggtccctagaccagaagtgaggaaataatagttaatttgctcattgtttctcaaattaaatcccacttctgtgaatctctttgtgatttactctttcaaaatggaattctagatggtatagtccagtgccccgaggcctgtgtaaattgttgaatttatggtgtgccaataccattatagggtggtcatctggttaatttgcaacaaagaatatgaggtttggaataaatgggtcagaaagcctgactaaaatgagaataacaattcacattcaattaaaaatgtgagtagcctgcaataatttcttattgtacttgggtaaaggggagaatagaagtagaatgataattaatagttgtaaatttaaaagtcagcttttttgcaagtgttaatttttcctggaagtgttgtacaaaatgatcaagttcctgtaattgcagaaacactgatcatggtatttataattgcaaggcatgcgaggtagctgaccttaagtgtaaactaattaacgtaggatttgtgtgatatgctttagcaaaagtagatatttgaaaataactgactttttttcattgtacaaatgacaatatttgtggcattttatttgtttaatattactgagcacaattttcactgtgattcttttcattttaaagcaagtatcaataaatgaaattttgtttctggcataataagattattacttaagcttgttcacaaaatattttataaagaacagcatcaatcacaactattatttagctactgtttgtggaagagtacaggcttttgacactcagcagttagtaataattatttaaataccatataaagacaagacaaattaaatgtataccattcagacattcggagatctcaccaggaaagacccccatgtataaacaactgggcctaagaagctcttttgcaaagacttggtggaattcaggacacatttttactcaggagaaccatatatagggtattcacttcacaggcaaatgcaaaatgtatcaggaagctgtatacatttcatggattttagaggagtctagtactagtttttagcagatctaactttatagaaaagcttatagctttccctttccttggtgtatatatatcagtagcacagccattctcgaatctgtttaggattactcttctgtttgctacctgtgtcacttgtcctgtgtggtgggtctggtagtatgtgttcatagcggggttgctttatgagtaggtccactggtgaggcagttattgacattgcagtcactcttccaagggcagcagcagaccgtctccatgggtgctgtgcttatgattttcagccacagaaagccaaggtgatgatgagggccgtccttgaccacgcatttggtccacacttcacaggacaataggagaggtggggaaggccaggcacagcagactgggacaggcaggccctctctatggaaagccctatggtgctacccatcaagattcctttgccttcattctgctgctgtatccagagatacccatgcctctcactagccttgcctggtatggggaggcaaacctgtttggggctggattttggctgtagggttgtgtgaaatagggtgaaatagaagaaggggaagaaaaaatctctcagtctaacttcttttctttactttaggcttcccgccaaccctttggtgaatttgaaagtagtgatcagatgctcatatgctgatccaactagcctagtttccacccttacattttgagtaaactactacaatccagactttaatggcactggacacacctttctcctcactaccattttagatttataacattttacttttatttactcaagccaaagtactcatttaaggtgtcctctaactttacaactagggagatggaataccatcaaatatataactacacttaaatatatctgtgtctatctgtatttgtgtgtatcatttaaatatctgttatacaaggtcataaataatccaggagtacagcatctgtttcacctgctgctctctttatgatgtgaagtgatgagtcacatgagtaattgtattacttgtataaagtacttggaagacagtttaacttgcataagtcctgtgctgtgtgtcataaagatgaaaagtttgagccatctgttacttaaaaaaaaaattaccccagtgtaccacctggtgtttaactaggccttgggatttgttccagatacagcactgcttcattgaacaaatattgggggtgagggtgggtggggtttggtgattacttctgggacctgggagggacccttttcactgagtcctgaacaacgttatttagatcattgttatttcctattgtggtttgtctgtcattaaaaacaattttgtcttaattttgaaaattggatatgaggagttacattacacaaaacaacattatacaatgatggagataatgttctgtgcagcatgatttaatttggagcagtggatagccacctgctaggcctttgttcttgtggcagtctggcaagtggtcccagtgttttgggtctttccttggtcacgtggctgttgagatctgcctgggttagttgcaaaccattaatccagtagcacagaatgatgaaatatttgactactgggtgtttgaagtaagaaaacaaatccttttaaaagttattattcagcaaccacagaatgcttttatcatgttgatataacatctgagtctttacattttatctaagggtagcctattcttatctacaacataaaaaagaaatctaggtaatatttggcattatggtaactagctaccatatagcacctgtctgcttacccactgtggtggggtaaccatataattcagtgattaaactggaatacttttgtcagtgacagagagctaggacgaaaggtgtaaacaaggatatgtagtcattttacttacaaggcatagccatattttgccatcttccatgatcaagaataactgactattcctcatgcatgtaagagtaattcttattttcaaattgcattaattgtgctggtatagtgcctcatataaagtaggtactcaataaatatttgtaaattgaataaatgtttatgcttaaagaaatcttaaagcttcctgccaaaatctttaaaaatgtacgttttagaagggctttgagttaaacatcctctgtattttcttgatattaagacccagtgtcaggattccccacagtggcattacccatggacctgtgatctaaactctgaaaccattttaatatgtagtatattataagagtaggaaaagcacttaattgcaattacgtattgttctgtctaaaataatttaactgtgtgctagaagagtgagccctttagtcaagtgcttatgacttatcttggtaacttatttactttacctttttacttgaagttgttaaacaattcagtggctacttaacatttccttaaatttactctgagagaaaataaggaacccaagtcatttaatttacttgtttgttagtaccttgtcagagactttaatagtacggaaagaaatttgggataatttttttcacgaattttcaatttttgtgttgttcactttagaaattttctttcatttaaagttttctctctccttgcaaggcctactttactatatatgacatagaaaagggtgcaggaatttctatccttttctatgtggtgattcttgcctgcctgggcagcttatgagacagattggatttagctcaaccctggaatgtgtgttacagtgtggtgggttttggcaagtcacttgtggtttagagggactctatgacgtgggctgggaactttggtcttttcttttggtttgaagtaggttttttaaaaaaggtgttagacagtttcaggttcgagaccttgttaattggtttaacatcccatctgtcctagtcactctgattctaatatgacagaattgaaacagatgctatttaaatctccatttctttattttattttagttttttgtatgtgtgcatgtgtctgatgatattgtagtcttggtctttctgtatctttccctttgacttttctacaatttctggtctggtttctttgtgtttcagcctttttcttcttgtccttatgttttttctttttgacttttttcacttgagtgacagagtttaccaagtcttattgtttatgtctaccctgatgtatcataatagtcaaacattggtcatgatagaacttgcttcagtacttcatgatttttatacagtagaactaaatccatgggaagatatttatttacttgttaattatcttcccattgcaatgtaagctccaagggcaggggttctcttttttttacgactgtatccccagagcctggaagtgtgctgagtgtctaacagctgttaaaaaaaaaatgaatagaaatgctttagttttctgagagtttcccaaattagatattatttagggagagtcttgaagttcctttgctctacagcacacccctgaaccttggctggtatttgaaccgtctaatgaagaacaaagtacttttgagagattctatttgtaatactgtaagattttttttttaatagattgagcatccctaacccaaaaatccaaaatctgaaatgctctaaaattcacaacattttgagcaccaatgtgatgctcaaaggaaatactcattggagcattttcaattttggattttccaattagggatgcaaaaaaaaaatttgaagtctgaacacttccacttccaagcatttcagataagggatcctcaacctgtagtctcttccctttctagtgctcattgtccctagactcgattttactactttatcagttaagatgcttgttggtttcattaatagaaatctcagctgaaactcacttaacaataaggacgtggattatgttgcacaacaggaagtacaagaaggcttcagagtgggttaattgaactcattgttgtcataagagacctaggttgggtctttttatatttttcttttgctttcttggcttcatccttcaagctattattttctgtgattattaggacaagggcagcaattagatcaacattttccttgttgtatgtaatgggaaagaggctggcatttctttccttgaagacctgagtaagaatttctctatgtttttattgggccaaattggtctcagattattctctcccgagtattggcaaaggcaatggagttatagcgattagcttggagtaatcatcgagagtgaaatggatgttggaatcaactacaacacttgcagaaaatcccatatgaattaacctttataaataaatttctaaagactgttgatttcctgagcttcaagttaaaacttccctgagtaattaggtttataaccaagaggatgcagggtgaagtcaacattatgataattacttcattagggaaatcatggcatttaaataaaaaaagtaacaagtttcatcttcctaaatttagtaaatattacatgcaacattgtttgtagaaagtaggtacagtcatgtgtcccatgatcccgtgatgtttcagccattgagagccacatacacatctagctatgtttagaaacacaaatacttagctttgtgttatagttgcctacagtgtttagtacagtaacatgctgtatagatgtgtagcctaggagcaataggctacactatatagtctaggtgtgcagtaggctgtaccatctagatttgtgtacatacactctgtgatattcacacagtgatgaaattgcctaatgacacatttcttaaaatgtatccgcatcattaagtgacgaatgactgtatgtaaaaatcagttagaactgacttccctttaagtctgtttaaactgataacaatcagtaagtttgaattatttaaataaaatgaaatctgtggactagaaaagtggaggagataactaggacatagtgaagcttactttaaaaaatacagagtcaatataaaaggtaatgtgcatctgttaccttaatttactgagaagtttttgatttacttgaacatgcagtaatggattatttttgtttggccaagtattttcagtaaattttaataggcatttggaagcattatgatattatggagaaaatactgaatcaggaattggaatccaaatttctggttctggtcctacctattgacatgatttctagtaaaacattcaacctctgtaagccctcatttctttgtaaaatgcttcctttttaattttcttaaaatgtctatttcttttcattgattgtaaccactgctttcctgggaattgagcgacatatatcattcctctagaggtgtggctttttagtaggattaagattatatgtaattaagtttatttgaacaagaaggaacaggtaaaaagcaaataaaagttgtgagatagatatcagttctgtcctcggtgtatacagtgattgtagagaagagtatttctgttttgaaatatacatgttaattcattagaaaggaattattttgtaggtataaacacattacattttcccaatatttcgagtatgtcattagccaaatatgagattctaatgttgtctggcatttcgaatagtgtcagacttctacatttgtaaataaaagactgaagcatagattccttaatcacctgtaatatagtaaaaagagttttggacttagagtcagaagacaaattggaatcctggctcagctagtttagaaaaaaccttggtagcatggcggaatgataatatggatgctggagtcaaacagaggcaggaatgagttggatttcaccacttacattaatacattttgatgaaagaaagtttggatacctttggcctgtatgttgcagaaaacaaccagaagtagcatgaatcataagtgtgttatctcatagaacaggaagtctggaaattggtatttatgtgttaattccatggcttaatgatatcttctgcaacacaggagtatttaaacttttggttctgtcattcttagtttgtttgtggtatcttcgtttgagtggtgatattgctgtaatagcaatagttcaagatattacatgcagtcatgatgacagccagtaaagagaggaattcctcccatttgtctctttttagtaggtagaaaaccattctcaaaagctgtagtacacaccattgattcaaattatgtctcaaactcagactaaaagttactcactagcaaggataatgaagatgccatgactgacttagacttttttttttaaccccacctttggatttgggggtggggaggctctttcctgagcacagcccctcatagggtaaacaacaaacaaaatcggatctctgccaggaagcaaatggggtgtgtagggagaagaacctgagttggcaaacaaaagtgatgagctaatcatcttgagtagaggccagtaggagatgcacagaaaccaagagagagtggtaacagaatacaacagtctgtgctcggggcagtatgcagggtgctacaggagaatgtatgagaaaacctgaatccaaagttgcaatggtcaggaaagacttttctggaggaaatgacagcttagttatcacctaagggattagtggaaaccagacaggaattagtcatgagcagcatacccttcttctgtatctataagagcacaaaacttagccatgatggtgtttcaggactattttaaggaaagttttaggacaaatgttggcttcaatacctaatcagtgtgcttgatgtgttagaaaaaaaaaaaagaagtgaaatgaaaagaaaagaaaatttaaaaaaagaaaagaaaaaaacacctaatcagaggtaagcaccattatctgtatgtataacaactaatgttcaaaatgattgttgtttttcaagaaaaagttatataacttttttttttgagatggagtctcactctgtcgcccatgctggagcgcaatggcacaatctcggctcactgcaacctccacctcctgggatcaagtcgttctcctgcctcagcctctgaagtagctgggattacaggcacccgccaccatgcccagctaagtttttgtatttttagtagagggtttcaccatgttggccaggctggtcttgaactcctgacctcgtgatccacctgcctcaccctcccaaagtgctgggattacaggcctgagccatcatgcctggcctatataactttaaaaatgctgtatattacagtatgaaacactctcttttaatctttgtaagattctaagattcaaaggacttgtgatcatgtagttcttacttctgtgaaaagcaatcattacttacttgatgcctgtaatgagaagtgtttattagaacaaaaactaggatgactttaattatttcaagaagcacaggtaagagactttaccctctgatgttaatgcaaagcatatacctggaatcgacattctgccatatctttacttgcatcctttaaagctgtttcttaagttttgattgaattaattaatttagaaaagagcttacactaacaagggtttttttcttctaatgaatcaggagtgagtttgcatgttttgctctccactgccatttttatatgttttgtttctctttaaataatactcgtatcttaattatttaaaaatgataccacatcctaagagtacatgatgtaaatcattcttagttcctaatacttactctccactctccaaagacatagacatcatattaggagactgatattcttttttcatattacttggataattcattgccccatatattcatggagaataattgcaaggcaaaccaacagatatttcaggtaacccagaaaaaggatatggtaagcacatttgcaaagaaatacttgatgaactagaattcatacactgtacaatgaaaataaagatttttatgatcgattttgacttaaaatttttcttttttttcttgttaaaaacaaaacaacatctaagctcaagaaatataatacttaacaattgacatagaaaagtcagacaagttctttatttatagagctttctaaataccttatcacaagttaccacaagataaatgtgtatgaaaaattagagccacctacctgttttggtttttgtaaaaatcaaatgtgagacatatactttattcactctattaaaatacatcagtgatgctaactttgatcatatttggacttttaaacaaactattttatccttaaaaaaagaaaacataaatgcaagcaaaatgatttcttatgacactttttaaaaatgaaaaatgcttttgtcaagatagacttatacttaagaaataaagaaaaagcaggatctatcgaccaggatgaaagatgttcttttttttatcataataacatgaagggcaaattaccaccagcttatgggcaagaagtaaataaaaacaaagtactatgatacaaaaaattctcataatgttcagttgatccagaagataatagtctaaggctattagctatgctagtctcttatttttaatattaaaatattttttattaaattttttgcatgttaagtgtttgtcgtaatcaatgatgtcccaaattcaatgcttttgttaatattaatgatactattgtctgttcttttttttttttttttttttttttttttgagacagaatctcactctgtcacccagactggagtgtagtggtacaatcatagttcactgcagccttgatttcccaggctcaagtgatcctcccacttcagcctcccaagtagctgacactacaggtgcgcacccaccatgcctggctaaattttttattatttgtagagactgggtcttccaatgttgtccaaactgtattattgtctattcttgttcactagcctgagccattcacctgatatgggtgacattttttcttttttcactgaaatgaaaattggcagacttttgctgcttctttattacccaatgttaactaatgttttccagtctagaattttaacttaactaatattttaaacttgtatattaaaataaaacacttggcatacataagagtttatagagtataacctctacatctgaagaattagggatacttctgaaggtgaggaaatcactttgcatcatgctatgaatttgttaaactgtttttattttgtgactagcagccttgttttatttaaaaaataaattttattgtataaatttaagatacgtgatcagacacatatatagtaaaaatattattatagtggaacaaattaagatcatcatcttacaattattcatttttccctgcctgtggcaagagcagttataatctactcatttagcaaaaattctgaatataatacaacattattaactatagtccttatgttatacattgcatctttcaacttgttcatcctgttgtgtttgctgctttgtatcctttgacctacatctccctattttctcccacttctgccagaatcactgttttatcctttatgtattatatttgccaaccctccccccacctttttaaaaaagattccagatttaagtgagatgatgcaatatttttctttctgtgtctggcttattttacatagcctaatatccttcaggcccatccatgacgggatcttctccttcttaaagactgaataatagtctgttgtatgtattcaccacatttactctatccatttgtctgtccatagacacttaagttgtttccatttcttggctattgtgaataatgctgcaatgaacatggaagtgcagagatcttttatgaagtggtgatttcatctttttggggtatatgcccagaaggtagattgctgggtcatatggtagttctatttttaatttctgtgggcacctccgtactgttttccatagtggtttgtaccaatctacattccttccaacagtgcacaagggttctctttccaccacgctttcatcaatgcttgttatcttttgtctttttgataacagctatgtaggatattctgaaaatatatttaaaatattcttatttttcctagtcagtatttcctgacttttctcctctaggttgcatgtattgctttagtaataaacaaaagcattaatgaaaacttcgttttgaaaaaattggatctgggatagaatttaccattttgttgtgggtttattttctgatatggatttattttactatttcacttgtaattttagtttttctcaacttaggtaagaagacgaatgagaaggtgagagacagctagtgcgtgctcatgggatatgacatttgaagggaaaaggatttgatagaatctcaggcatttgataaagagttatttggcacttgcagtaagctaagcactgttctggtttggtgcacactgtgatgaataagagagtttctcagccttgtggggattggggagataggaactaactaaatattttcaaaataaaaacaggatttcaggtttgataggcttgataataagcatgcagcataaagtaaaaaggagtgatgaggtcaaatggggcctattttatataatatggtcagggaaaccatttgaaagaggtgatatttgaacagagacttgaatgctgtggcagagcagaagtttgtgaagagctggggaatgagattttttaaaattatcctgctgttggacagaaagtacagcaagagatgatgtggcttggatgagtgtggtgccagtggagatgagaagggcttggatttgaattctgtcttgaaggtagccttggaggtagattgtgcaaatgaaaagaagagagcaatcgggtaactgcttgtttcattttgttttggtttggttgggtctgggttgagtactgggcatatgttggtaccatttatctgagatgagaaagaacagaagaggagtttttctgtttgttttgtttggggtgggatgggtgtgggaatgagaagtcaagaagaatttgttggtttgtatacttgatttgaggcatttactagatacctgagttgatatgttatatgtatgaggctggagtttggcatataaatttgggaatcatgtgctgtagatggtgtgtaaatccatgggactgcagaagatcacccagagaatgtgggaaggcagagaagagagaaccaaggactaagaatgtgctcaggaggttgaggagcactgatcagtagaggtggaggaagtcgggggaagtgttttagtgaagcatgtttccagaaggaggagtgatcagctgtgtaagtgttgctgagaaattgagttagatgaagactgaagattgacttactggatttgtcaatagggaactggtggttgttctgatgagcagtttcagtggagaggtggacacacaagactgatttgagtgggttttaaacagaatgagagccaaggaagtgagataaagtacttattgcattttaggggaggtttgctataaagggaagcagaaatggagctagagcttggcaggggttgggaagatgtagaatcaagggagagtttttattttgtatttttaatacaaaatacatgcgtatatttatgctattgagtctgatccattatagaggaaaaaagctttgtagaagggaaaaggataatttacaggaccaaagtatgacagaaaggctaggatctagcacacaagcagaagcatcaggcttactggggagtgaggacagctgatctattgtaacaggtgggaaaactaatatgttgatacagaacaggtagtttgatagatatgatggtgtaatgaaacagcggttccttcttcttgtttctgttttctcagtgaagtcagaaggcaggtaatttgctgagacccttaatggggaaggccttattagagcaatataaaatattttattttaaaaatactactttataaatgtattcttcacttagctgttgctttttggttgttattgtggttagcaatatatgtctgaatatgttttctttaaacaggtagagttgagtttccctgggccacatagggcataagtcaggagccctcaccaccttttttgtatatggggaatttgaaatctagaaaccttgtgtttttttgccttctccctcttctggttctctaatttttcatcaggcacagtagagaaggagaaaggatggtttcatttagttcagtgtgctcattcagctgttctgcagcctccaggtcttgagagttgttgagcataatcccttgcacagtgaactgtcccaggcttgtgaaatcctagtggccactctaacacagatgactgagttgagatgttctttttgttcaggttttaaagtgaagtgccaccctttagcaggtagagattatatacatcattctgttttctttgaggactccaagtgcccctcttagctgtaagtagtagagaccaacgttaattcatctctcaatcttgtattccattttccagttcatttccctgaaccatattttcctcatttgtggagtaatacttcccactcatgggttcttcatcaggcagcttatgatgcatgtgaaaattgttctggaaaagcctaaacagtacaaaaagagaaatcctattgtcatggtgataattttgttattctctagaagacattgacagttccctaggaccaccccttaaactcttgtttttcatcttacagaggcatccatttcttgttttatttcttctgttaggggcttagtgtagtgacttgagtactgtttagggttttgatatatggagttcaaatttgcatactacaaactgggggtgaaagaaaagaagctgaatatattgcctgttttcaaatagtttattattcttctaactttttaaaaccacaagcttccctcttatcacatttttacaaatggatatatgaaagctggtagaaaaagcttgaatttaagatgataaaatgaaccttgttcttatgtttttctttgctaattttcaattctgctggagattagcatcttctattagcaaggtgtaaaaattgagtgcagattgcagcttttgggagagtgttcaaaaatatttttactttttttataattaaaaaaaacttcttactatttggaaaagaaaaaatgtctaatgacgtcatctactactgtggtatttcttcttaatcctacctctaggggcaaatatttcccatcacaataatagatttttagtcctggaagaaaccttagggttcatctttttaaaccattttcatgtaacttgtgagaaaatgaagactcagagaagaagatttgtctttctgtcagttcatggcagagtccgggttcaagttgaggtctctggacagtcagtgtgtagggttttccttcctgaaccatcctgccttttaaagtttacagttgtgttctcagaaagagaagagtgaagttacccagccacagtagaggaggaggatgggcagatgagttctgtgtacactttgtgcatttaatttgcctcagtcttctcaatggttttaactcattaccacaaaatatagaaaacaaacaggttctttgagttgtgctctctttgaaagctctttaatagtaattctgaattatttggtctttttagtgtcatcctagttacttctgataaggatggtcagaggaccaaatacagttttgtttctactaatacgagtgtacataggaatttttccagctaactgtgacatagtatttatatgccatgggttaaaaccactttcatgtgggttctgagatacataggaaggttgaaaagactttagagacagctaccatggttttatttctcttcttctttttgagggctgggaaatctcaggttatttaattttagagtatttttaattaaaatattttatgtttaacctctattgtaaaatacaataaaaaatttaaaaaccacacagaaatgtatagtttagcgaattaagtaagataccctgtagctcttaccactagctcaagaaatgaaacattgccagccactctggaaaacccttttatgttccccatgaaactcacagatctctctctacctcaacaagtaaccactctcctgacttttataatgcccacttctttatgtttccttatggctttttcccctgcttgtgcttagataataaagttaaatcttgctcattttaaaaagcctggtacgtattttaaatctttcttaatctacaggctcccctccatttctttctattccttacagtttacctgttgaagaacctgggccttttgacctgtagcctttccgtagtctggattttggtgattgcatattcaaaggtgacaagatcatggttctctgaggattggcttcctcatgggattggcttccttatggcatagggaagttactggtcttcttgatgtggttttgggccctgtggtggctttaagtcatttggtggcactgttctgctttcctggttgcaatgctaatggatacaggcccatatataggcattttttgtttgtctacctttttctttaaaaaaaaatttgcacaaatttgtggggtgcatgagaaatttagttacatgtgtgtaatgcatagtaaacaagtcagagtgtttagggtgtccaccacccacgtacagcacatgtttgttaactgtagccttcctactctgctatcaaatattgaatttattccttctgtgttcttaccctttaagccacctttcttcatcattccttctccccagtcacccttcccagcctctgttatctgtctttctttactctctacttcttttttgtagcccaggctagagtgcagtggtgtgatctcggctcacggcaacctttacctcctgggctcaagcaattctcctgcctcagcctccctatgattacaggcatacgccaccaggcctggctaatttttgtatttttagtagagacagggtttcaccatgttggccaggctggtctcaaactcctgacctcaagtgatctgcccacctctgcctcccaaagtgctagatttcaggcgtgagccctcgcactggcctctattctctacttctgtgtgatcacattttttaactcccacatgtaagtgaggatatgtgatatttgtctttttgtgcctgccttatttcacttgagataatgacctccagttccatccatattgctgcaaatgacattatttctttttgttctttttatgtatttatttatttttattatactttaagttctagggtacatgtgcacaacgtgcaggtttgttacatatgtatacgtgtgccatgttggtatgctgcacccgttaactggtcatttacattaggtatatctcctagtgctatcccacccccctccccctaccccacaacaggccccggtgtgtggtgttccccaccctgtgtccaagtgttctcattgttaaattcccacctataagtgagaacatgtggtgtttggttttctgtccttgagatagtttgctaagaatgatggtttgcagcttcatccatgtccctacaaaggacatgaactcatccttttttatggctgcatagtattccatggcttttatgtgccacattttttaaatcccgtctatcattgatggacatttgggttggttccaaggcaaatgacattatttcattctttttatggccaaatagtattccgttaggtatatataccacattttctttatccattgatggacacttaggttgattctatgtctttgctattgtaattagtgctacaataaatatgtaagtgcaggtagccctttaatatgttgatttcttttcctttgggtagatacccagtagtgggattgctggacaaatggtaatcttatttttagttttttgagcaatctccatactattttccatagtgtctgtactagtttacattcccaccaacagtgcgtaagcattccttcttctctgcaccctgaccaacttctgtttttttttttttttttttttttttgagacagagtcttactctgtcacccaggctagagtgcaatggcatggtatcagctcactgcaacctccgcctcctgggttcaaacaattctcctgcctcagcctcccgagtagctgggactacaggcttgtgccaccacacctggctaatttttgcatttttagtagagatgggatttcactattttggccagactggtctcaaactcctgacctcatgatcctccccccttggcctcccaaaatgctgggattacaggcgtgagccaccgtgcctggcccgattttgttattttatgtagaactacttttatattgagagccatacttgtggcctcaacttacttgcaggttactctggaagccaactcctgtgaaggcaggggactcaaattatcatttttccatctttaattatgaaggtcagctttcatttgctgtgaaaacaacacggataatttgggaccataatacgttctgaaatagttcaagacaagcatgttaaaaatgagggtttttttttttccccactgaaccttccctcaagattttattgtcttcataataaaagatgatgcttagaactagttaatttggctctttctcttcttttctcctcccggttcaaaatgcttgcttctcttaataggcagcattctcttagatttgcaactgggctcaaagcactgaagcctcatcacagtcttctttttggcagtagcctttttacagaattccagaaaatgggtttagtatgcccaccatagccactctgcttcctgtcataatgctgcttaccctgggcacacatagaatccttgtagtagaggcaggaggcagagaaattgtagacagacaggggccggaccctggtgaaacctcaccatcaaaaacaaaaccaaaaaaacagcctgaaacccgcagcccaaagtgagaacttctgttcctgtttgcccactctcttctggttggttctttctgattaatgcctttttaccaattgaatgttgccttttccaaaactacctatgggctgccctgcccccatcctgtgcctataaagaccccagactcagttgggagagagaggagagagagacagacagccagacagccagcctgacatcggggtagagacaacctgactttggggaagatgacctgcgcttcccatcccctctccacctccactttctgctgagagctgttttcattgctcaataaaattttccatcttcaccatccttcagctatccatgtgacctcattcttcttggatgctggacaagagcttgggacccatcaactgcaggtacccagaaaggctgccacacaagccctttgccctttccagtggagggcagctgccccatgtgatgaggcaaggggccaactgagctgttaacccaccactgtccgtggacagtggaactaaaggagcactgtaacacccactctggggcttcagggtcgtgggcaccctcacctggatgccacctcaagggccagctgagctgctaacacacgctgtctgcggatggcagaactaaagaagcactgtatcaccccctctggggctttggggtcatgggcatcctcacctgggtgcagctgtgttccccttgaggcgacatgcctggtctggctgtgggccctgcgcggagcttgctcctgtgtcggcatctggagcaactggccaggtcctgcacttgctcgctcatgtgttccctccacaaggggttgagtgtggcaggccgagtagagggggcacccctgctgggagtccggcaaaggggccgacaaaaatcctgcattacttgctcttcttgcactgtgtcattttgtagggttggtgcttgccacacgcgttacagaaagtttgatggtttttaggaatgttcaccatgtttataggagtgctattggaacagaaagaaaaatgagtttttttaagtgtcctaaaatactgttagtctctgcctcttgcccctttagtggaactttttgattatgcagaattacaacttgctgaagcccagttgaggtagctttgaaggaagttcatttcttcttttgcctctgttcagaggttggggaattttgtgactatgtaaatttgctaaggagacaccattccagattcttatctttcccaggactcaagtggctcttgctttgccactgtttttgctgttgtttttgagacagggtcttactctgtcgctcaggctggagtgcagtggtatgatcttgactcagtgtaacctccgcctactgggtttaagtgattttcccacctcagcctcccgagtagctgggagtacaagcatgtgccaccacacctggatactttttttttgtattttttggtagagatggtgtttcaccatgttggccaggctggtctcgaactcctgacctcaagtgatctgcccgccttggcctcccaaagtgctgggattacaggcatgaaccaccacctccagccacttttgtattattttgaataacaaagggcatttttgttactccctgcaagggagtagcttttacattaataccttttctttttgaaaatggactttgataaaagatgtaaaaagactttgtaaaattttgtttgataaccttttatgaggttaaaacaaagtttaattctgattacatggccaattctaaatttgagaccaggtacagtggcttatacctgtaatcccagcactttgggaggccaaggaggacagatggcttgagtttaggagatccagaacagtgtaggcaacatggtgaaacccgtctctacttaaaaaagaaaaaaaaagctgagagtggaggtgcgtgcctgtagtcccagctactcaggaggctgagcctggggggcggaggttgcagtgagccaggatcatgaccctgcattccagcctgtctgaaacagtgagaccctgcctcaaacaaacaaacaaacaaattcatttggctgtgtcttccacctgaaatcagattgggatctcatagtactacagctctcatagcattcaggtagatggagctagaaataagcccaagtatgcattttccttcaggactttttaacactaagctagaaaatataagtatctcataaaccttatccctttaattaaatttttagtaggaaccagaatgtaaatttcttccttccctaccccagaatgtagatgcatgtcctcatttaattttagtcattcttggcgaatgtgataattagggtaaagtgcaatgagatttgcaaattggatggtgaattcactaaatgtaacagctgatcagggcttctcttctcagtgtcactttattaaggtcttcggatatactgatatattctggagtttcctccccacccccgcctttttcttttctctctttctccccttgttgaaagatactaacttctacagtgttggtgtgagtagagtatcaggatattgatcttaggggaggtgaactaattatagatttgttttttcattttatgagaggctattcttcataataggaatatagaatatatgccatatacttgaggttacttttgttaatccctttaagaatggagcactttaccttgcttaacaagaaggaaataattgattcagatgctgcatgctgtgcaaggtgagttttgaatgcagtgaggcgtatatgcagtggtctgacttccgtaagcctcactcatctgactttcctttggttcttaatgttacactgaagactagctgggcatggtggcttatgcctgtaatcccagcactgtgggaggctgaggcaggcggatcacctgaggtcaggagttcaagaccagcctgaccaacatggagaaaccctgtctctactaaaaatacaaaattagccgggcgtggtggcacatgcctgtaatcccagctatgcgggaggctgaggcaggagaatcacttgaatctgggagaccgaggttgcggtcagctgagatcatgccattgtgctgcagcctgggcaacaagagtgaaactccgtctaaaaaaaaaaaaaaaaaaaaagaaaaagttacactgaggactaaactctaaccttttttctctcttgcccaaattcttatctaagggatctagggtgtcacaccctacaaaccatataaatttcatcaggtgggttttatttaaccctatataatatgccttacttttcaacctgactctggcataatatcacataacagataagaaaaatcaaaatattttaccctaaaatacgtttttttttcttccatatcttaaaatggccctgcaaagccatcttttataggggggagtatttgcatctgagagtctatcaccttttaaaggtttggataggagacatttgccatttatttgtctctaagggtggccacctataagacctcatctgcagaataaccttggtctccacaaccccccagacagttctattgattccaggtcttagataataactcttttgaccaattgccaatcagaaaatcttggaatccagctatgacctgtgtgaccctccccccacctgttctccatatatcctacttttctgcaccaatccagtatatacctcacatgtactgactgatgccttttgtttccctaaaacatatacaatcaaactgtaaccaagcgaccttgggcagatgttctcaggacctcttgagactgtgcctggagccatggtcactcatattgagcgcattataaacttctttaaatattttagagttttactctttttgttgacaacacaaaaataccattgaaccttaaatttcatgttacagggaagtgacatcccaaagactcccaggatggctaaacagtagaaaggagaacttttattggtgatactggtttgtaagctgggaagaggaagtctccagcatagactgaaggtgctctctctttgaagaggaaaaggacagactgggttttatgcctcaccagttctgtattacacagtggagtcatatatattcagcaggtttgggggaaaagctacatatttatgaggagagctgagtacaagcacaatgagtaaacatttatgtaacatataccccatattcactttgtggtggggttttagcattaaaatgagatggaatttcactatctatatcaaaaggtgaacaaaagcacacaaagactttgtgcagcccctataaactagctgaaactggtttctggtctccagtagcttatcggaaaagaatgtttataaggcccatcatctgtctaatcaagtggcctgggttgtaaatcagttctgaaaatttgcctgatagctcctattgttaaggagttaaacaagagggtggttactcttatagccataggaatttagaaaaatgccatgccagccaggccctgaacccttgacccacaggtaactgtttccttaactttagggtctgtcttagttgattaaggggcatcattttgatcttgcaggtcacaggaggaaaaaagctcttccactaccctcttaggctcagtagctggggtctatgaatcaaaatgataaaggacagattaacaggaataaaaacatacatataactacatatggatatacagggtttaacaaatgaatgtgacttaaggacacagttagaatttggggcttatatcccatcttaacaaagggaatgaaatacagagaagagtcttgttagacaaagaagaaaaggtttggggcttcttgaggggggtaagttgtgggaaagggactaaaaagggtacagtaaataagggtcatttgtaaggttttttaaaatgcaaactagagtcttttcaggtgccaagagttgtcttcagagtagttctcttcctgatactggagagggagacacctttacaaatggaactttatgtgctgtttttagtaagatggggaaggacagggagatttttttctgtgtctgctttttcttaaatgctttcagctgaaaatagttcttatgctatagtggcatatttttggatggtatattcttgtccccttccatgaggaaatgagttttgaggtgactgataatactacaccagactttataagggccgtatttggacctgcaatgagttctgtcctatttgaactcagaacattaattttcttttgctgtttttcacttaaaaatattctaatttcaaggcagttttatagtgtgtgcaatatagtactgtagtactgcatgtatatattttatatgtagttgcatgtatttggggtacatgagagcttttctgttctttgcttttgttttcactggtgagtgccttcataaaatgtctagtggccactggtctgtgaacttatttgtgtttattaatgtacaaataatgtcctaaccttttatttaagtgttcatgtgtatttctgtataatttgtatatttcagtggagggtggtctttccaacttcatgtgtgttctttgaagcaaaaattcctcttggtatctgacaggtatctaagcttatattgtatgcacgataggcacaaaataaatattcattaatgaatttcaaaaatcatatataaaaggaagttgttgattttcatcgtttactccagaaatttttatggattcattacatagcagttagaaatggtgatggtagattgagtagataagttagaaattgacatattgagaagtaataggtgacacccacaaaagaaaaagaagagtgaatatgtatggcttattgagattatttattatggggccacacagcttgatggagcttggtaacccctagcttagggcattattatattgaagcaaaggacagtgatagatgatttccagtaatgacactgtctttactttgatcttggacaagccatttaatctttctggtcctcagtttcctctttcataaaacgaaatgacagggctagaaagcttttgatgtcttttaaaaatttgaaattctacatgtactccgattatctgaggcagtcaccttaccaagtcacttagattcgctatattctctataataagaaaggtaaacacgttgtggaaacatttttattagaatgcttactcttttttcttttcttttctttctttttttattttttttgaccaaaaatgatttgggatgtagttcagttttttgacattaaaagggcaaatttggatgaataggtgaaaggtatatgaattaaagttttataataataacatatggcatttgtgattaaacaggaagtgttaaagtaatgaactccctacatctgatgaaatgaagcagaagccacatgatcacttatcagggatattgtagaaaatattgaccagttgggtaaaaatccattcaaacaggcaaccttcctatccaagagaaactcccctaatgttggggaactctttgaggttacataaagcaagttaggcaggtagttagggaggtactctttatgacatctgtccccttagattagtcttaatcttgggatgatgccttctaaggagcttgtcaggatgcagccttcccacagctgctggggaactctttcctcttgctctgttttggtgtcaggctttgagagtttcttcttttttttcttaatgtcttatccaacaaaagtagttatttacaattcggagtattttctttcacaggtttttctatgcatgtaccctctttataaaaattggacatagtttacatcctgttctataacttgctactttcgtgtaaccatatattgtggacacatttccttgtcagcacttgtagatctctataattctcagtttataaagtacttactgcgtggcagcacttttaaagtgctttcacatattaacatttaaccctcacgacaacctcatgaggtaggaaattctattacaggtaaagacgctgaagcagagagaggttaagtaattcccctatggttatatagttagtaaatagcagagccagtgttagaacccaggcagcctggcttaagtctgggtgctaactattttactaccctgcttctcaaatgaccgtaaggttcctttttgtgcctatgccgtgattcatgttagctactcctcgtggttgtacttttagttctctcctgtttcctttttgctgctacaatgtgccaggcatactctaagcctggtagcatgcttgtggactaaaatacgccaaaatccccatctttatgacattcatgctctggaggaaggaggtggttggagacagactattaaaaggttaaataagaaaattacattggcctggcacagtggctcatgcctgtaatcccagcactttgggatgccgagatggacagatcacttgagctcaggagtttgagaccaggctgggcaaaaccctgtgtctaaaaaacaaaaacaacaaaaatcaaaaagtatctggggcatggtggcgtgtgcctgtagtcctagctacttgggaggctgaggcaggagaatcacttgaacctgggaggtggaggtttcagtgagctgagatggagccacaccctgaaaaaaaaagaaagaaagagaaagaaaagaaaagaaagaaagaagccagacccgaaaagaaagaaagatagatagatggagcccgacccgaaaaaaaaggaagaaaggaagaaagagaaagaaagaaaagaaaggaagaaagaaagagaaagaaaagaaagaaaggaaagaaaagaaagaaggaaggaaggaaagaaaaagaaaagaaagaaagaaagaaagagattacatggtagaggaacaggtgagaagtactgtgaaaaagaaataggccaggtgtggtggctcatgtctgtaatcccagcactttgggaggccgaggcgggcagatcacttgatgtcaggggtttgagaccagcctggccaacatggtaaaaccccgtctctactaaaaatacaaaaattagctgggtgtggtggcacgtgcctgtaatcccagctactcgggaggctgaggcagggaattgcttgaacccgggaggtggaggttgcagtgagctgagatcacaccactgcactccagctggggctaagaagcaagactccgtctcaaaaaaaaaaaaaaaaaagagagaaggagaaataaagcagggaagcagccagtggtgttgctgtggagtataagagttttaagcagatgagagggcgatgtgagcaaagttgaggcagatgaaggaaagtgagccatgtggacatctgggccaagaatgtatcagtggagaaacagcaagtgccatggcttaatgtcaagtgcatgcatgactttttttcaggaacactcagaaggcctctgtggctgaaacagagtgaatgaggaaagagtaggagaagataagggaaggaacgcagaagggaggactgcccaggtagttagagcttcgtaggccattcttatgaactattagtccttgtgagatgatgatatatgaaacgattttcaggagaagagtaccatgttctggcttctgttttaaaatgaccactgctgtgttgagaccaaagtctaagggaatgaagatggaaggcagcagggaaaaagtgttactggcttagaccatggtggtagctgtggggatggtgataagtggcttaaacctggacatatttctgaggtatgttgaaacatggtatatttctgagtgggatttgctgatggattgagtgtgagagaagttaagagtaattctaagagttatgggaagaactggaaggatggacttgctgttgactgagattaacttgcacaaatgacttgatgctgaatttttaaatcaaagaacaaacttacggcctttagtactttagatacagcttttaagtcactagcctgagaagctaggtagtatatatgcttcattatcttgaaggattggagtttcagttgtagagaagtggaaacatgtgtcatagagacaagctgtctatcaggtgacataaataggcgttgacagtaattttcagggtatgaaaggttcagtttggcaggttcaggaatttgattttttaggtttacctagagttaaatgggcccaggcacagaactcataagtaaccagtctcatccattcagtttgtcatggagccccatcagaccatagccaacagcagccagcctcccaggatgacaagatctctccccttaccttgctgccaggacatctggtgaaagatttccagggaggatgacctgtagcagccagcctggtaggactcagaagcatcatcttctctctttttttaaacattattttttaattaaaaaaatttttttgagatggagtcttgctctgctccccaggctggagtgtagtggcacagtcgaagctcactgcagcctcgaccttctgggctcaaactctccttgcacctcagcctcctgagtacctgggactacaggtgtgtaccatcttgcctggctatgagaaccatctccttttccttttctttttttctttttcttttctttctttcttttttttttttttttttttttgttgttgttgagacagggtctcactctgtcacccaggctggagtgcagtggcaccattttgctcagtgcaacctctgcctccggggttcaagcgattctcctgcctcagccttctgagtagctgggattgcagctgtgcaccatgacacctggctattttttttttttttttggtatttttagtagagatcgggtttcatcatgttggccaagctggtctcaaattcctgacctcaagtgatctgcccgcctctgcctcccaaagtgctaggattacaggcgtgagccactatgcctggctgacaagtatcttcttacaagtctaaggaatcattcccgttgtctgcacttggttcactttggagccataaggctagttaagcccctctgatgcgtgttttatttttactgtacttctcattcattactcattgtgcgagcaccacagtcaccattttctaatttctgcaggtaccacctttgacttttctccatcgtttacttttccgcccttcatttttcccatgtagtttctttttcaaactttttgtatgtgtctcattgaatttctctttctataatgaaccaagtttttaaagacccttaacctcttcacagaagtctgtatacgtatcctcatttcttccccttaaaataaagctacaaaacatttaaactaatctttcacagacccttgttgcccttgtaaagcagatggaaacacagtaacaggtggcactgtaggctggggaggactcttagtctcagctgcccagccgccccagtgcccctgaccttctccctcagggacctcagtgggagtcagggtgatggagtcatgctttcagggaaaaccacttctcctgcataacgttggtatccttgggtctcttgataaaggtgcatgatgactgtcccacagctacttgcagctgtccttgccatctccacatctctgttcttccattcttcccttttacatgaaaacttggcttctaaagcatatttcttccttctcgctctaaactgtgaactttagatcagtgactatctttgtgtctttatttttccttgtgtctggcatgtgatacatgaacaaattgtagaatgaaaacatgaaatgcttgtgaacaaaagttctctgaaaaagggatttggaggaaacagactttattccagtgcaccatgacacccggctatttgaagcctttagtgtaaaacaaaggtgcattctagagaatgaagaggaggcttgagttgtataacaaaagttcccacccaggtttccaatcaggtccatttgtgcaaatgaaggattgaaacttgcttagttttgattggccaacacagctgagttctgattgttgaatgcaataaggtttttgaaatatggtattcatggaatctggagatcttgggtgctcctgccagctccagcactaactatggaaactgtgggactttaggcctcaatcattgcctcttcttaaatcttaatcttctcatctgtgaagtaagggaatgatattttgtcatctttaagtattttttattatgctatgaattttaagattttgtacaggccgggcatggtggctcatgcctgtaatcccagcactttgggaggctgaggtgggtggatcccttgaggtcaggagtttgagaccaggctggccaacatggtgaaaccccgtctctactaaaaatacaaaaatttgccaggtgtggtggtgcatgcctgtagtgccaactactcaggaggctgaggcaggagaatcaattgaacctgggagatagaggttgcagggagctgagattatgccactgcactccaacctgggcatcagagcgagactctgtcttgaaaaaaaaaaaaaaaagaaagaaagaaaaagattttgtacaaattgtttcttccatttggtttttggaagacaagagggaaaagcttctttatgttttctatattactcaagttaatgctctagaaaagggtacctctctttatttagaaatatgtttcaagaaaaaatgacccattatattaaatttatattgtttttatattagcatttcaaggctatctgaagtgaagaaatggaaattaatactattttaaattttcttcaggtattattcttatcaccattcatattttgcaggataaaagcttttaaaaatatgtctgtgctgggtacatttttaaaggaaatttttttaaggcttttattaacctgaacaaagctaaccagacaaaaagaacaagctgtaagaaggtactgttgagaacaaaaatactgtgtgaatttgcattaaaactttgctactttatttggtgacttgtaaagtatggtgttaatattccatgacagctatgatttcggcttagattatagttctggtctgccttagaattttaaagccaaatttaaaaaaataatgaaataattttttccccaaagccaatgtaattccacatcattgcccaggctggtctcaaacgccttcctgggctcaagctatacacctgcctaggcctcccaaagagctgggataaaggggcaagttgctgcacctcttttttttttttttttttttttttgagatggagtctcactgtgttgcctgagctggagtgcagtggtgcgatcttggctcactgcaacctccacctccctggttcaagcaattccctgcctcagcctcctgagtggctgggattacaggtgcatgccaccatgcccggctaatttttttgtatttttagtagagatgggtttcaccacgttggccagactggtctcgaactcctgaccttaggcaacccacccgccttggcctcccaaagtgctgggatttcaggcgtgagccactgcatccgaccttctctttttttaaaaaactaatttcaacttttattttagattcagtgggtacatgtgcagatttgttacatgggtgtattagttcattctcatgctacaaataaagacatacctgagactgggtaatttattaaaaaaaagaggtttaattgactcagttctgcatggctgggaaagcctcaggaaacttacaatcatggcagaaggcacctctttacaggggagcaggaggcagaatgagagctgagcaaatgggaaagccccttataaaccatcagatctcatcagaacttactatcatgagaacagcatgagggaaacgactcctatgattcagttacctcccactgggctcctcccgtgatatgtgagtattatgggaactacaattcaagatgagatttgggtggggacacagccaaaccatatcaatggtatagtgtgtgaattacttaatcatgcacctcaatttttctttgaattttttggtgttcttattcccttaaaataagctttcgcctatttcatgtcacgagaacattgtccctgagttgttatatattggctgtactgttttcaagtattctgcatgactaattacataatggctattaccctgattaagtgctatgtaagtgctaaccacagtttttattgtcatagtatcattggttctttgttttcacctattatttttgatcctatagaaatgtttgtacacctctataaaactgtaatgttttatattcaattggattctctcacactttgacactgctgcatccgctgtcatcaactatcactttgaaatctatcctcacttattctcagccagccaacttgcatttcagagatttgatgggcattgctagaatctcagattcagtgtgtcctatgttaatttattaccttctatcccagtgctcagctctgacaaccagtggaacaactatttcttttttttttttctctctgttttcttaagctgtggattagcaaactattagcaaactatggcctgctgcctgtttttgtaaataaagttttattaatgttagatgcccattcgtgtaagtattgtctatggctgcttttgcactaaggtggcagagtttaagaagttgcaacagagaccttatgaccagcaaagctgaaagttttgacttttggtccctttatagaaaagtttgctgacccctactttagactaaaactttggcattatctttgattcctcctttggtatttttcaagtatattctagcaagagaactaatctccatttctgtaatcatcatcatctttttaaaaatcttccggccgggggcggtggctcacgcctgtaatcccagcactttgggaggccgaggcaggcagatcacgaggtcaggagatcgagaccatcctggctaacacggtgaaaccccatctctactaaaaatacaaaaaaaattagccgggcctggtggtgggcacctgtagtcccagctactccggaggctgaggcaggagaatggcaggaacccaggaggcggaacttggagtgagccaagacagcaccattgcactccagcctgggccacagagcgagactctgcctcaaaaaaaaaaaaaatttcctccacatgcgttctggttctctgatccttttgcctagggtattaaattaatttcctcacctcctggcttcttttccccttctatttagggcaaacagaaggggaatgtcgatgtcaaatgtattgacattttacactatgtcaccagtgttatgttctcaaagttccactctgccaccaaaacttaagagatttccatattgcccacaaaattagagactctcaaccctcttaagattctttctacagtataagccctctcattctcccaattacagaaattatttctattaatataatgaaatactttcctcctccttgtctttgttcatgctctaacaactgccctgagctttctgtgcctccatctccatttttcctactcctgtcttgccaataaaaatcctcctagatttcctcatgaagctttttcctgtgttttcctttctgcatattctttttgacttcgtggtatgttagctatccatctcactgtcaccaaggacaccttactgaatgctgtgtttttaacgttcttttatatttcaaatattataaaccataagcttgttgagtgcaaagcacttgtcttcttcattaccgtgttctcttaaacactgagtgtaatgatgtcttagatatgcttaataagaaattgaatagcattttaggaagcaggctttttgaatttggatttaattattagtcatctcaatgtctcttggatgtttggcagaaattctaggtgttataatgaaagttcttgaaaaacttgatgttaacgtctttgtatacatggctaatgaaaatggaaagatttttttgtttgataaggtatttcacatttaatacaagaaaagtatttatatgcaatgatgtgcttggtactgataaaaagtaaaaccaggtggcagagccaggcaataattctcttggatgtgttatgcaatctaccaaagtcagatttgtttttatttcgttaacaagctttttcaagattccaagaagaaaaattatatcaaagtgttcttagaagctattgaaatgaaatgcaggtgccgttaaaatagtattttgtactctgtctattcatttatttaatcattctctctgtacttcccagaaaattttgatgtggctgttcatcacaaagagcccaattttttgttggcatctagttctgaatttgtactcttgaaaaagttgacaaagacaaagaagtgtgccaggtttagagaccttttactttgtagtagtacagtttaatgtcacaccgacagaaactcagctgctaatacccttacctttctcagttggtttcagaaacctagaggttgcttgtagtggtgggaggagggacccaattgggtacataacacgcagtgcccaaagactcagcaataaaagtgaacaaagcatcaaaacacactccaatacccgtacacatgcaaaagaattaaagacttgaaaatttaattttaagatgggcaaaggatttgactagtttctaggagaggatataagttctgctttgttcactactgtcttctagcacaaaataaatgtttgctatatatatgcatacccgagtgaataatgtcacatcaaaacatattgctagcaccctcttgagtaaagaaatgcttaaaaaatagccatatatgtatacttttgagccagcatttctacttcttagtttttttttttttttttttttgatacacagtcttgctctgttgcccaggctagaatacagtggcgccatcatcattggtggtgctcaccacaaccttgaactcctggggcttcagtgctcctcctggctcagcctccagagtagctaggactacagacacgccccaccatgcctggctaatttgtttatttttagtagagacaaggtctcgcgatgttgcccaggctggtttcaaactcctgggctcaagtgatcctcccgccttggcctcccaaagtgttgggattacaggtgtgaaccactgcacccaattacttagaatttatactgaggaaataattacacaacagagtggggatttcacatctaggtttctgtaatccagaaatactttctcaaatcttcaaatatgtttgtatgtacaaagcaccagcttgttttcccatatatgcttgcatatgtgagggatagtcttgtgtctggaagtaagcatatgcagtcaactttagcatgtctctagggagcaggactgaggagatgggggaattactagcacgtagggtattataccttttatttactcttctctgtttcagtttttttaaagtatattttacttttatattggtcaaaagactaggaaatagtctattaagttttaggcatattttcattaacatttaaaataagtaacctacttggagagttagcttgcctatctggaaaatgcagttttcaagaatgattcatatccttgggaataaagtaaaaaataatgaatttttttgttttataatgagacggtaatgaatggcattatcagattggactgctgttgtgttctttaatgctgcgataaatagacatattgtacagaagttttattatgtgttctttaaccagttgtaagaaaatcttgtttcatgtgagataggcctgttattatttggagaactaatatgcactaacaacagtttccaagagtatacccatgagcaaaggaattcacattgtcttctcttcaatcttttagaaaagctcaagaggagaacaagaaaatcgtactggctggatgcgttcctcaagcccagcctcgccaggactaccttaagggactgagtatcattggggtaagcttgtacctgatgcaaaaagagaaaatcttacattgttaacacctgtaatagctccgcattttattttctgtttgtaggttatttgtaagctatgttacacttatggctgtcctaaacatattttccttattgtccctgaaactgtcatttctgtgtaactttttcaccttagcacaaaaacatgtgttagtttctctcattaagaaagagcaacacaataaaaagccatagtgtggaatttacatcccttaataacccggtctttggctgtctgttaccatcgctttccaagtcattacagtttttccacctcactcagctacttgcttttcgccccctagtacatcaatgccttttttcaaatgccccacttcccttatacctaccaccacaagtctcagctccaacatgacaacattctgtgaagccttctctgcctactccgtgtagtccaccataattattctctctagtttctctttgcttactgtgcagttacctgtcgtataattctttgaataaagcccacctgtctatttaaattgttagcctcatgcgaatagtttttcaatctttttttaaaactctcaccatgtttctctagcctttcctgtgatacctggcacatagtaagcactcaataagtgtttgttgattgcctgaaaaaaatcttcccgttgtatttctgttgttagcatacttttttttggggggcgtgggcagtcagctctgtgaagtaaggagactactgtctattctctctctcttgttctttgtagtcaattactctttgactgagtaaaaatgccctgaagtagctgatattcagtcaatatttgttgatcaaatgatggtgcttcttccttcccaacattctactgaagctgtaggtgataagctcagcaatgttgtttgtttaaaaaggctacattaatttaaaaaaatatgtaaaaacatcatatgctcatagaagaagtttacataattaattggcatctgctttgaactttatgatagatttttccttatttgatatactactgacaggttcttgtatcatgttctcagtgtaatgaacttgttttctgctgtgaagtccttaccccactagcaaatttaataatctttgaacaaacattctcactttcaacaaacagaacctgaatgtttggtaactttagtttgttttcaccatttgtctgtttacattttgatttttcttggtttaaggaatgaaatgaatatgggactcccgagttatcttttcatgtcagactaactttctctataaacataatcctgctgtggtagggaaataggaaactagttggaagtcttttttagagatggaatgtggtaaaaacttggagttgatcttagatttcatctcaaggaattacgttagagaatagcagaatttctctagtatggcaaaaggctcttctctgcatacattttggcaacattttttaaaatgccattgtgtgccgggaaaagcgtatgttaggatgtacaggagattctccagatgcagtgtaagggaggacacttagtgctattaatatgagtttatttgccaatgtcacagctttgtgtcagtccaattttcagggccgacacaaagctgtgacactggcagataaacatttttttttctatttaatcccacacctttgttgttctgtggttaacatttattttctttaaacttctattttaagttgaggggtacatgtgcaggtttgttatacaggttaaacacgcgtctgttgtacagattattttatcacctaggtactaagccttttactcattagttatttttcctgatcctctgcttcttcccactcactaccctccaataggccccagtgtggtgttaccgccagtgtgtccatgtattctcatcatgtagctcccacttaaaaatgagaatgtatggtatttggttttctgctcctgtgttagtttgttaaggataatggcctccagctccatccatagtcctacaaaagacatgctcttgtttttgtttttttatggctgcatagtattccatagtgtatatgtaccacattttctttatccgatatgtcattgtaggttgattccatgtctttgctattgtgaatagtgctacagtgaacattcacatgcatgtgtttttgtggtagaatgatttatatttctctgggtatatacccagtaattacattgctgggtcaaatggtagttttgcttttagctctctgaggagttgccacactgctttccataatggttgaactaatttacactcccaccaatagcatgtaagtgttcccttttctccacagtcttgccagcatctgttattttttgacattctgataatagccattctgactggcatgaggtagtatctcattgaggttttgattttcatttctctaacaatcagtgacactgagctttttttcatatgcttgttagccgcgtgtatgtcttcttttgaagtgtctgttcatgtcctttgcccactttttaatagggctgtttgttttttctcttgtaaatttgtttatgttccttatagatgctggatattagacctttgtcagatgtatggtttgcaaacattttctgccattctgtacattgtctgtttactctgttgagagtttcttttgctgttttgttctgtcatatagtcccattttgttaccactagtagtctttaggtttatcttattttgttcatttacaattggagaaataagaacacattttgaagagtgagtagaaataaaatctatatttctatcgccataatgcatttaaaattttgcttatcttcttcagacttaacctttgcatcttttacttaattgtaatctcaaacctattttgtattcttattttttgatgttctttcatgagttttttaaccattttaagtgtggcattagtgttctattgaaggatataacgtactttacctatttcttaattattgtatttaagaattttctagtttttaggaaatatgcataatacattaatgctctcgctggtcttttaaattttttaaatttgaaattagtatattttgaaaagtttctgaaagtggggtcacactatcattaacatttcagaggtgtaatttaattatatgtttaccagcattacatattattaaagtataagattattatttgttaatatcattttgtagagcatttttttctgtggcaggtatattacattttatttatcatcactgactttttatatatgaaaattatgtccacataactaaaaattttgaaaacaaattacaaattaggaaacaaaattatctaagttttacctttagagagacctacttttgaatagaactgttgtatagaattgctataaaactagaaaccttctcaaatatagtgagttacagtgaaataaagaaatgaattatattttatacaaagagaaaacagttctgaagtccaaaaagaatagatgtttaaattcagtgacttgggaaactatttttagcaggaagtttagaattgtattgcacgattgagtaaagaatgctattccttcacaaaatttctatgatgggaggatgttaatagagttggaaggaagaacaactgtaactgcattctttgcttttatcttctgctagcctttatctgtgtcaccttacagtacaggaagaatgtgtcaattctgttgaccaggcgattaaaataaaaaacttccatgaggtggggatcattgggtgagcaagctgcttattgtacatctgagttaaaggacttttattgtacttacccatgtttgaaagtgctcatagcataggcatttaagaagatattaatagataaagagagaaattactaccatcataacatgctggtttccatcaatataagcctgtaggaatggggcatttagtttagtaatcagaacaaggcagtgtggtgagaacacatggtaagcaattttttgacctctgggccttttattatcatctgtcccactctctcctgaaatcacctagttgtgattaatattatttgtgtgatggtgcatggaaagaaaataacaacattgaaaccagaaataaagcctgccatcctctgagtccagatcctctggctttggtggctgtaacctctgcacttctcccatcttggagcaaaaatctgtgcacaaacctgtctaatttcttcacaatggaagcggagagagaacagatttgaaaacatgtatgtcttgaataaaaagttttagccaaaatctttttcacaagatatgaaactatcttagcatgaagtgaagtttaaattttgtatctagatgatgtatatttatgagtgaccagtatagaatcaggatctttttgtctctttttaggatcttgaaacattttaccttacagttaaaaattccctttctcttttaacaaatagttatagttaatcatctaccttagagttttcatgcaatgccatttttattactgctatttgtttatgtcatttatgttagctgtagatagtttcatatcttgtgaatatatctgtttgaatgtttctgtttttcttttaggctaatttgttggcagaaagtttcttttagattagttaaccagaacataggatgttctcttaacatttgcagtaaaaaaagagtagtagacttcaggcttcagaaagcctagcttcaaatcctagacccaccatatcattatttatttggttcagcaagtacttactgagtgcctactgtgtgcttggtgtactgttccttgcacagtactatgcaagtgctgggaatgcagcagtatataaaatcgtcccagatccctgtcctcactgagcttacgttctggttcttagggagagaattctggtttgagtccagaacttctccagcttcctggagaatctagtgagatgggtccctagaccacagtgagatcaattagttgggaatttctctttaaggctcagatggaaatgcccttggtgtctgctggttgtgagttgtgttagggagagatgagtgaaacaatatttatttgctgagttcttcttcctaaggtagtgttatttatcagttattacagtatccattattaacaggaacaacatttattaggaagttaggctctcactctattactagaaagtgtgtttatgaaattgtgtgctttgtgtagtttttctgtgttattaacaaggaccacatttgaagttggtcttggtgttaattcattggactgatcattgtaactaattatagctctagaaattctaaataaactgcaaattaatagacacgttgtaaaatgttaagacatgcaattcacaacggaatatacaatttgatattgaaaatttgtaaatgacaaggcttcctcatgtgccagctgtgagccctgcaggcaggtgaacattttctttggagagctgaacagaaatgtggtttaacacaggtgtccacttatctcagggactattagcaggttgatttgcagtggttaaacatcttttcaggcaggctgctctaatctcgaaaagtgaaacaggattgacttttgactatttcaaatgcgagcactttaattttgaaaattatgtgtacagttaaagctgcatttgaacggctaaatttgagaatatttctatcgtacaccatgttgcaaaaggtaaacaaattcacaaagtggagcagtgtcacagtaacagtgggatcagtattgagggcaaggcttgaggaacgctctccttctcctgtttgcccctacttcgaacatttcttcttgccatgttctatttttttttaacttccgttgtctaaaaggtagtattgtgagagaatgacatgtaaatttaaacacccatttatgtttttcccttccttgacctgttggtttcactttttttggcatcttctaatctcacctgtattcatatatgtttcacctattgaatgattaaaatgtagtatatcatagtgattaagagtatggattcaggaactagattgcgtgggttcaaattgctgatctcaaattctcggctaatactaacaatagctgatgagctaaaaaaaaatcgccaaaaaaaatctaataatgttttaagaaagtttattagtttgcgttgggccacattcaaagctgtcctgggccacgtggggcccagaggccatgggttggacaagtctgatgtgtaaaattgtttattaattggtattttacatctctaatgtgtatttgttttagttataatattactctgtgtttaactttggtatcactttttaaattatcttttaatttgcaacatgttctgttatttaataggagtattctgatgtcccaaacactgtttctgtgtgtgattgagcttagcctgttgaattttgtttttattgctgaaggggttttgtgcctcctttacccctccccgctacagaaagtttaatcggtattttagttgcatttaagaggaagagaggttcctggtaccaatcctcattttactggcacccttctagcctggcttcatctttcagttagttatttttatctctaactcagtattagtcactcactggtactaccattcaggtgaaatatgccttcagtgttatgaggaatgtactgtcatgtaacttctgttgaaagggctatttctacctttggggaagaatctttttgaatgaagagattaaagatgaaaatatactgggagatgagtattaaagttaaatcacacataacatcaaatgctgttttgtgttacacagcaaagttgctcacgggcttgtgagttcaagaaaaatcttctcatagcgttgaaacacattaagctagcttagtgactgctgtcagcttccccacatttaagggatttggaaattgagccctcctccattactatgtaaggtagggacttggcttaatagagaagttaatattgaactttgacttgtcagatgctgattattcaatcaaacttcgttatggtaaaggggaaacatctgaacatatatttgatggaaaagactttatatgtatagttcttaatggagatggaaataagggcatttctttccttttttattgtatatatttaaggtgtacaatgtttttatatatacatagtgaaatgattactagagtcaagcaaaataacttatccatctccttctgtagttactttttatgtttgtgtgtagtaagagcacctaatatctactcttagcagattttcagtatacaatattaaatatagccctgatgatgtaattagatctctagacttgtcctacataactgcaactttgtaccctttgatctacttcacatttttctccccctccccaccccggtaatccccaggctactccctgtttctctgtatttgacttgttttaagtaaagcttttacacacaattgaaatcatgcatttttttttcccagtgtctggcttagtttacttagcataatgtcctccaggttcatcagtgttgtcacaaatgactggatatccttttaaaaatgttgaataatattccattacttaaatataccacaattattttattcattcatccatcgatggatacttaggttgttttcacatcttggttattgtgtataatgctgcattgaacttgagagcacagatatctctacagagtgctgatttcatttcctttggatatataaggattgctggatcatatggtagttctatttttaagtctttgaggaatcttcatactgttttccataacggctgtaccagtttactttcctaccaacagtgcataacggttctctcttctctacttcctcgctgacactcgttatttattgtctctttggcatggccatcctcagtgaggtgatagctcatggtggttttgatttgtctttccctaatcattatgatgttgaccacatttttatatatgttttcattggctatttgtatgtttcctttggaaaaatgtctattcaggtcctttgcccatttttaaataaggttatttaattattttgccattaagttatatgaattccttgtatattttggacatgaaccccttatcaggtatatggtttgcaaatattttctcccaatccataggctgccttttcattcagttgattgcttcccttgctgtgcagaatcattttagcttgatgtagtcccatttgtttatttttgctttttgttgcctgagcttttggtgtgatatccaaaaaatcagtgccaaggccaatgtcaaagatctttttccctatgtttaaggagagagagttttctcccaggaatttcacagtgtcaggtcttacatttagacctataatctggagctgatttttatgtatggtgtagtatacagattcaatgcagtttctatcaaaattccaatgacattgtttgcaaatatagaaaaacagttctaaaatttgtgtgaaaccacaggagactctgaatagccaaaacagtcttgaaaaggaaaaagttggagacataacactttgtggtttaaaattacagtctaaagccattgtggctagcagtggtttgtgcctgtaattgccgcaactcaagaggctgaagtgagaggatctcttgaggccgagaatttgagatcagcctgggcaacatactgaaaccttgtctctaaaataataataatgataataataacaataacaaaaattagcctggcatgatggcatactcctgtagttccagctacttgggaggctgaggcaggagggttgcttgagtcgaggagttccaggctgtggcgagttccaggctgtggtgagttccaggctgtggcgagttgttgtgattgtgccactgcactccagctccagcttgggaaagagagcaagactctgtttctggaaaaaaaaaaaaaaaaaaaaaaaaaaaaaaaaaaaaaaaagctatagtaatcaaaacagtatggtactggcataaaaatagacacatagacgaatgggaacagaatagagagcctagagataaagccaagcataccaaggatatgcactcaactgaagttttttcaacaagcccaccaagaagacacactggggaaaggatagtctctttatggtgttgggaatgaaactggacctagatatcactttttccttttacagatcagtggagttttcaggtagttttaaagttttggttgtggtattttttaattggaattaaaatgacattgtctttttatttatttatatacaatcaaaattaagacagctaataagaaagtactttgcatgtatgtgtatatatatatgtatatgtatgtgtatatatatgtatgtgtgtgtatatatatatataaaatgtattcacttcttttactcctgaaaggatttgaggtatcttgggataaaatcaagagatagtaaaaccccagccagattcatgcagtcttaataagagtcataccaactaatagagaaatatggacaaagagcactgtttcacatttttaatataattagcctgagcaatgttgttaatattattctattaaccctccagtggctttcatttgcaaatagaataaaatttaaaccacatagcatgaactgctgaactgcaagatctcacatactctttctcccatcattatgtgacctcatctcttaccactgtgtccctaattgctgtccctcttttgaccacacaacccatttatgttatttcagcctctcagtccttgtgcttactcttctgccggaggttcgcattgatgcctctgtcagtggttcgggtccctggactgatgctacctattcagtaagtttaactggactgctgtagaaaaattttgctctctacctcctaccactaatcccagattttcttttttttcttttctttttttttttgagatggagtctcactccatcccccaggctagagtgcagtggcacgatctcggctcactgcaagctccgcctcctgggttcacgccattctcctgcctcagcctcccaagtagctgggactacaggtgcccgccaccaagcctggctatttttttgtatttttagtagagatggggtctcactgtgttagccaagagggtctcgatcttctgacctcgtgatctgcccacctcggcctcccaaagtgctgggattagaggtgtgagccaccacgcccagccccagattttctttttcttttccttttttgtttttttttaaataaagacggggtctcgccatgttgtccagggtggtttcaaactcctaggctcaaacaatcttcccgcctcagcctcccagagtgctgtgattataggcatgaaccaccacacctggccccagattttaatttcttcatagtgtctgtcattgtagcaaatgaaaattttccattatttgcagtttctttcccctaattagactataaggtccatgaagcagggatgttgtattttttgtttgtttgagacaaggtttcgccctgtcactctggctaagtggaatgatgtgatcacggcacactgcagcctcccaagtagctgggactgcaggcacatgccaccacacatggctaattttttgtttctgtaaagatggtgtctctagttttccaggctggtctcaaactcctgggctcaagtgattctccctcctcaccctcccaaagtagggacattgtatttttcactgttatgtccccagttactagaactttgtagttcatagttagtgtttaacaaatatttttcaaatgaatgtatttatgccaatggtgatttgtgggggagagtttggagaaaatagttgtctgagtctcttgaaagttcacgttcagttgaagggcattttatgatcatttaataataacctccatgtgcataggagaagggagattcatcaagtggaccacctatctgccattcctggacaagatgtactaggaatcattggcaaaaatctatcttgatatccttgtgcctcaaatctctcagcctcagaaataacagtactatcagccaggcgtggtgactcatgcctgtaatcccagcactttgggaggccgaggcgggcagatcacttgaggtcaggagttcgggatcagtctggccaacatggtgaaaccctatctctgctaaaaatacaaaaattagccgggtgtggtggcaggcacctgtaatcccagctactcaggaggctgaggcaggagaatcgcttgaacccaggaagcggaggttgcagtgagccgagattacaccactgcactccaggctgagcaacagagtgaaaaaaaaaaaaaaaaaaaaaaaaaaaaaaaaaagaagtaacagtactgtctcctcctccctagtagtgtttgaggattaagtgtgataatgcacgtgaagtgtcagtgtagagcatgaaacagagtaattgttcaagaaatgttagctgtcactgtgttattcctagtcattaacttatctagctgctggtttttcaggaaaaatgatacttcaagtgcatactaaaacagaaccttcgactgcagagtagtgtcagcttgttctccgacggcttcaaatgagtggacttttttttttaaagcctagttggcaaaattgtgtttgagatgtatgttcatttcctaaggctgccataacaaattactgtaaactgagtggctcccttagccattccctaaagctgcacttttcagtgtggctgcagtagccacatttgactatttaaatatgaattaagttcctcagtaacagtagccacatttgaagtctgtaataaccacatgtggctagtgactatcatagtggatggcacagcatataaacatttccatcattgcagaaggtcctgctgacagcactgctctgagtgattaggatactttagaatagcatttttatttgctttgagtgccattgtataggcttgtttcttcaatacatgtctagttataaatttggaatagttgataatagctgaataaaatatttttgtggatttctttttaaagttctgcagtagaatgactcattaatgttatttatgaattgtttatacaccaactcctttcttcattgttgagaacatatggagtcagtaataaaacatactgcctgtctttttttgtgtgtatttataactaagtgcctcaaggacacaagatactgttttatttattttatttgaattacatgctagagaataagctcttgtgtattcagagcctcaatttatatattaattaagaacaactttccttttctcccagaatgagttcaatatattcttcattactgtatgtgaattttgagtttgttttcttgctctcgattgttttttcttctttctctgcctcccacccttcattttttttttcttctgatgttttcctcttccgcgtaactccccctcccctgactcttctctccgtttcctcttggtctccccttttttcccttttccccattgcttcctccgttgtcttccgtactggaaaccaaaatggacataatattatctttaaatcatttaataaacttctcttctgtttgtaatcaagtacttacattttttttttaaattttacagttttggcagatctttctttttaaggtcctggggttcccacacaccatccagtgatttaaattatcatgtgttggcaatattccacttcctgccataaaagcaaatgtaatcaagtactattttaaattagaggatatattttcagctatatacattcaagcaaattctgtgtgaccatcagggtctccatcttcatcaggccatctttgtttcttctatgtgcatgcacacatgtacacacacacacagacacagacacactcttagacttttcattttgacgtagtatcactcagaaatgttgcaaaaataaagagttcctatatgctctttacccagattccccaaatattaacattttaacacattttctcattctttttatgtgtacacattttccccctgatcccgatccttatgaaagtgagttgcaaccatgatgccctttacttctaaatacccatatatttaaaaagctacgacacactcttaaatcactatagtacaattatcagtattaatacaatattataaactagtgtattagctttattcagatattgccaattgtttcaatactgtcctttataggaaatgaaaagtctcagattcatagtagcattcaggtcaggtctcttcagtctcctttaatctggatcatttcctcagtttttcgttgactttcatggccttgacattggaacctttgaccactcccaacgttttttttctttttggtaataacaactttactgagatataattcacacactatgcaattcacccatttaaagtgtacaattcattgcattttagtttattcatagaattgtatgaccattaccacaattaattttagaacattttcatcatttcaaaaaaaacgcaggtacttcttagcaactgcctttcattctccctctgcccatccaaagacaatcactaactgacattgtctctgtagattttcttattttggacatttcctattgtgacctttttgtctagcttctttcactttgcatttatagcatgtaaccatacttcattcccttttatggattagtaatatgatcaggcaccacgtaacaaactttaatcaatgatgtatataagtcagtggtctctttagattataatacagtatttttactgtaccttttatatgtttagattcttaccattgtgtatcagctgcctgcagtattcagtacagtagcaggctgtacaggtttgtagcctaggagcagtaggctatatcatatagcctagttgagtagtaggctgtaccatctgggtttgtgtaagtacactctgaagttcacacaatgaagcgatgacctaataacacgtttctcagaacacattctgtcttagtgatgcgttgctgtatttcgttgtatgcatatgccacatgttgttaatctgaatggatacttccgttcccagtttttgcctattatgaataatgctattatgaacatttgtgtacaagtttttttatggacatgttttcatttttcttggagttataactaggattgacattactaaattatatggtaactgtttatttaatcatttgaggaacaggcagcttattttccaaagtgctgcatcattttactgcattcccatcagcaatgtatgaaggttccaatttctccacattttcaccaacactcgttattatctgtatgtgtgtgtgtgtgtgtgtgtgtgtgtgtgtgtattttaagagacagggtctcactctgtcacctacgctggagtccagtggtgtgatcataggtcactgtaattttgaactcctgggctcaagcggtctttcccccttagcctctcaagtatttaggactacaggtgagcaccactgtgcccagctaatttttaaaaattttttgtagagacaggatctcgctgtgttgcccaagctgggctcaaactcctggccttaaagtgatcttcccatattggcctcccaaagtgctgggattacaggtgtgagcaactgcacctggcctgcctgtctttttgttggtagtcatcctactgggtgtgaagtagtatctcattgtgttttttcagtagtggtaaactacacataaaatacaattgaccactgtaaccatttttaactgatgtggagtacatttacattgttgtgtagtcatcaccactatccatctctagaatattttcattttctcatactaaaactctatacccattaagcaatagctccctattcctacgttacggttctgatttgcatttcctggttggctaatgatgttgagcatcttttcatatatttattggccataagtatattttccttggaaaagtgtctgttcagattattttcccatttttaattgggttgtctttttattattgagttgtagaagttcttcataaattctagatataagttccttaccagatatgtgatttataaaagttttctctcattttctgtgttgtcatgttactttgttgatgttgtcctttgaagtaccaaatggtttgaattttgatgatatccaatttattttttcttttgttgtttttgttgtttgtgctttggcattacatctaagaaatcagtgtctaatctaaggttcatatagatttatggctgtgttttcttctaagacttttatagttttagcttaccctcaactttttaacagactgcttcctctgcatgttctgacttttctctagaaatatggcttcttattcagtccatgtgctacaagagtggatgcagtgcttttgagcttttatatttttaactgcataggaaaacatttttctttatggtttcatcatggaattatcttatattttattcattttattgtctgtcttctatccttaattgatatcttggtcattcacccacatccagtaggaaatttgaccaactctttcttatcctattcatgtctgtattatctttggcaatctgagtgtctggatataatgtcttggcaacattgtcacctctcacttcatcatacatcagttccagcagtcatcacctacaccttgtttcagcaacctattcccattgccagatactggaccttactattcttcagaaatactaaatgcctgtgtctgtactctggttataactttctgtcctttttcttttctccttcctttttttccccttcatttttttctttctccaacccccagccacttcatttcttcttttctggctctatttctttccctgtttaacctatttgccaaacttcgtctcatctaaaatgcatagttaactttccttgttccattttctttctagtccattccacaaatctcttagtgttgtttcatcagtcctttcaaccatcctggtataatttagatgctcaataattgatgagtgaataaatggtggtattaacaaaccttgggtcagtctgtttgtctgtttggctcctactgtagaactgctgggacttgagaaaaattatagctctacttggagttattgttataaattcatggtctcatatttcaactggtgtcccaatattgtgtggtgaattttatgtgttcttagtcatcactgtctcttgttgtctgtaataggtatttgaaaacattcattctgttattttatgatatgctttctaactcttagcagatgaacttctggttactttactgagaaaaattgagggcaacaggtgggaatttgcttagattctccctgacctctacaagagtactagcatcttttcccatgctttacccctaacctcttctttcaggagacgaagagttggcccttttctcactctgacttgttctctattcatgttttagattttgctcggtctacttcctgaagatcattgctccatcacttgtttttcagtctacagctcctttgcctactgcctttctctgctcaaactgcaaaaaaagaaataaatagttacttgtacgaacctaaaccaaaatgtaatatattcaatattctctagccatcaagagcctttcttctccttccctttctccccagctttttactgagtacaaattaactctctctgttttcttacgtataattcattactactgaactcactgctttccctaagtttgattcccgtattgttaaatcaaacatattcattttagtctgtatacttatgtctctgtagtatttgacactgttggtcacttcctcctctttgaaatctttgttctgctggcttcttcaatcacattctgtatggaagccacatgggctcttataataaaaccagggcctaatggttccattgtttcctggtagatgcatctccggttgggtaggtttgttgggggctgaaaacctaatgttgtctgagatttacttacctttggcagtttctcagtaattattgttgctgctgccatcatgttgggctgagtggtcagacgtagaatggagttcaggtctgctctcacaagcctttcctcattttctgtaagatactgagaccaaaggaatatttttaagagaattaccatttccttccttccttccttccttccttccttcctttcttccttccttctccccttccttccttccttccttccttccttccttccttccttccttccttccttccttccttccttccttccctccttcccttccttccctccttccttccttcctttccttactgtgttgcccaggcttgagtgcagtggtgtgatctcagctcactacaacctccacctcccatgttcaagttattatcttgcctcagcctcctgagtagctgggactaaggcatgcaccactacacctggctaatttttgtatttttaatagagatagggtttcaccatgttggccaggctggtctcgaactcctgacctcaagtgatctgccccctcctaggcctcccaaaatgctggaattataggcatgaaccactgtggccagccagccattacatttttaataaagttttttaaacaggttcctcttgtctcagttgagttcattgcagagttgtataataatgaaagaatagaaattttttcatcaatagaggtatggatgcatgcatcacatcatgcatccatacagagagatagtaaggtgaatgaaatagacctatagactgacaatatatagaaaaaacatcaaggcacaggtgtattttatacatatgtataaccccctaccaaagaccccgggacctcactgtgttgccccagctggtcttggtctattttgtatatcttttttatatatttatttacacacacacacacacaccctctatcatttgtaaaagaaggataaaactatagaacagacctatatgtaaatgtttgatgccagaaaatgtcatggtatctgctcatcacactattattagtggtttcatctgaggagtggaaatacagcatgaaagatgttatgatttctttcaactgacttccattttatattctattttgtttgacttttttgtgatatttcttctgtaataaaacaacggtaatttaaggacttttaaagaagaatcgactttgacttattctttttttagctttgtgaatcataatattactttgctttttttcattttccttttaaactctagccatgcttactcattctcagtgggtttctccaatcataatcctgtttaatcataaccccaggagtcatccttggttctctaggaagcattcctgcatcacttggtctgattttattacctttcctctgtgttcccatggcaaagcttccttagtctctggtgtatagaacagaagctgtattatttgactttgtatttcatggacctgagtacagtacccagcacatggtagaaattcatcaaaagggttttgagtattaaaataataaagatagaatttggaacagatctccttaatactagcatgttctttttgtgtagcttgtcgttttatgccattttttttcctgaagctctgtgtgagaagacatgtgttaattaaacttaagtttctgtctcaggatatgttgagtatatgttgataggctatcctaaaacaactccaggcagtttatttaaatgcaatatgatatcttcagttatcattggaggacaggagagtgataatttcatacttcattgaaacacaaaatattaatataggatattttttatagtgtctccaaatacattaaaggaaacctgcattgatgtgcttagaaaatgtgtaacattgactcaagcataaggataaacacaaattttgtttcttcgtgtaaattacttgtgtaatcgtttttttttttttccaggttcagcagatagatcgtgtggtagaagttgtggaggagacaattaaaggtaatcgttgaaagtgagataaacagatgtatatattttctgaactacatagtagaaacaccactcaggtaactcttgccaggcacctttataaaagttattgttttagatataaaatcataaaatgttatccttggcttcatgaatttgccagtctaatattggaggcaggcactcgctgtatatttgtttggcttataaatgaatcaggcaaagagcaatggcttactcctgtaaccccagcagttggggctggggctgaggctgaggctgaggctggaggattcctgaggccaggagttcaagaccagcctgggcaagatcctgggatctctgggggagaaagtcagcttgatgctgtggtgtgcacctgtagtcccagctacttaggaagttgaagctggaggatcatttgggtccaggagttcaagtctgcagtaagctataatcatgtaactgcactccagcctgagcaacacagtgacaccctgtctttaaagaataaatgaatcaggtcatagttttcttttttaaatattattttatttttgtgtaaaatgaatttagtttgaatttcagattgaaagaatttaatcaattttaagataaagaaattttctgggcacagtggttcatgcctgtaatcccagcactttgggagactgaggtagttggattgcttgagcccaggagttcgagaccagcttgggcaacatggcgaaacctcatctctacaaaaaatagaaaaattagctgggtgtggtggggtgctcatgtagacccatctactcaggaggctgaggtgggaggattgcttgaggctgggaggttgaggctgcagtgaacagtgattgcaccattgcactccagcccagttgacagagcgagaccctatctcaaaataaataaataaataataaggaattttttatttgtacattttgttatcacataattaggttgttttgtaagtacttttaacagtaataattttgatgcttgttcaaggtgtattttttatagttacactaaaaattacacaaagaaagtagaattaagctttgcttattttgttagccaacactcactgacatagattcttattgaagtcactgtgaaataaaccatcttcaactctgtggtataattttaaatttttaaaggctttttcctatgtttgattagcacaaatgaaaaccaataatatgatactgaaatattaagtgaattgaaagtctcacttaagtactgttttgttgtaaatgagaaacttatattttttaaaaaaccatatagtctccacgtgccaaactggaaattttaatgctgcacttttccttctgggtggtgtctactactttccacatgcttctattcattaattttgaatcattgccttatcagagattattacagaatcaatttctaataaatgagattatgagaatatgagaatgagactataccttaatctttttttattattttttaatttttaaaaattatttattttataaatagagatgagattttgccatgttgcccaggctggtctcgaactcctggggtcaaacgatccacccaccttggcctccaaaagtgctggaattacaggcatgagctgccatgcttggcccttaatcttcttttgatgttccaaaataaagtgaaatatcaggattaaaaatttatagcaatgataatttgaatgtttttacaaactacttcaactccgtcctggagaatccagaagtgctagcatttattgtgtacctacagtgtgacagccactatgttaaacacttcacatgggttaagtcatttaaccttcataatagtactgtgaagtgaagtgggcataaatattttcctaattttgcagaggaccaagttgagacacaggtgcatacagctagtaagtgacagcattgggatttgaatccaggcagtctggctccaaagcctgtacattatactgtgatttatacgatactgttatttctttgctctctcacagttgagattcactaccttaaatgttatttgattgagtgtcttaagcagtgatttaagatacttgagggcattgttgccttattcatcctttgtcttaagtaccaggtatatactggccactcaataattttttaaaaaaattaatgatgatgaagaatataggagaaaatctaggtgatcttgatgtggcgtgattgtttagatacgacatcaaaagtatgatttatgaaagaaataattgccaagttggatgtcattaagttgaaaattttttgctctataaaagacactgtcaagaggatgggaaaataagccacagagtgggagaaaatatttgcaaaatacacatatgataaagggctattatccaaaatatatgaagacctcttaaaactcaataataagaaaaggaacaacccagttaaaaaatgggcaaaagacctgaacagacaatttactaaagaagatatgcaaatgtcaaattagcatataaaaaggtgtttgacatcgtatgtctgtcattagtgaattaccaattaaagcagcaatgcaatatagtggtatgttaaaactatacacctggtacaatggtcaaaatccaaaacattgacaacaccaaattctggcaaggatatggagcaacaggaactctcatttattgctggtggtaatgcaaaatggtacaggtactttgaaagacagtttggcaatttcttaaaactaaacacagtcttacatcatccagcaggtgtgctacttgatatttatccaaatgagttgaaaacttacgtctatacaaaaacctgttcagtgtttatagtagctttatttgtaattactaaaacttagaagcaaaaaaatggccctttagtaagtaaatagataaagaaactgtggtacatgcagacaatggagtattatttgacactaaaagaaatgagctaaaaaaccatgaaatgacatagagggactttaaatgcatactatgatgtgaaagacatcaatctgtaaggctacatactctatgagtccaactaattggacattgtggaaaaggtgaaatacggaaggagtaaacggatcagttggtgtcagtgattagagagtagggagggatgtgtaggcagaaaacagaagatatttatgacagtaattctattctgtatgatgctgtaatggtggacaattgtcattatatatttgtttaaatccttagaatgaacaacaccaagcgtgaaccctaatgtaaactgtggactcttgatgaaaatgatgtgtcagtgtaggttcattgattgtaacaaacgtaccactctgttgtaggatattgatagttggagaggctgtgtgtgaagtgggggcagtgatatatagaaactgtacttctgctgagtttttctttgaatctaaaactactctaaaaaataaaatctattttaggaaattaatggtaattaacagtgtgcttaggagtttgccaaatggcctggagagataaaatttctatgggaaatcatacaagacctgttactcccaggctgagttaatcatggatagctccttactgatgagcgtggacttgagtggatttactggagagattgtgtgtgcatttggctatgaaagtgagtcgaagatgaagttgaaggggatattcattggcaggtttggttagaggatgggaagtttgataattaagccttcataatgcaacaggagaatttttcagatggaaggaataattttgatagctttccttagtttgcagatcaggaagctgagctgtgaaggagttacatgatgtttttgagatctcttagttaatagagaactgtgcctatcagtcaacttctgttcttcgctttctatgtctactgccagtacttcattcagacagcatatgtcactgaaataatgtggttgttacagcagttagccagttgttggttgtctttcagcaagttatttttctgaggcttagttttctcagcttaaaatggtcaggattaaatggataagacttttgaggtacacagaacatattaaggcattagttcatgttaatgcttacctcttacttcctccttaatataagaactgctggaataatctaactgatctttgccatcagtgactctcctttcaatctgactgcatatcctgctatcattaacctgggattattttactttcctgtatgtatactctcactggtgcctcttacccaccaagttaatttgggactttctaccattttcacttcttttgtccatgcatgctgtacattataccctttgctccagccaactgtgctgcttgatgtttcttatatattttttcactgtgctttacatttacttgatggtcctccacagaagtggatatcttctgtttgtccttccacatctattctccatcttgatctgtgtccttggaggctgacctgtatggattgaatcagtaagattcttgccatcttatgtccagttggatttagccaattggaggatgtgacaagagagcaagctaagagtatccattcccgtctctccttccctccctgcctattttgggttggttgctttccttaccctaaggtcacagctcttgtctggtgaccctccctgtttatctttctccaggtttctgcagctcttctcttccttgcctctgggatggaaacagcaccccgttgttgctagcctcagagtaccgcattgtctgttgattttcctaaccctgcccagattttagtaaatcgttcctttatgaaaatcttcttagttatgcagtgagccatctgctttgctggtaccctgattgataagaagttagctgtggagaagcaaggctctgcccagaagggccagatggaataccgcctgacaagaggattttgctataaccctcttgtttccacatttgatccctgttgggctctcttcatatctcatctttgaaggggctttagacatacagcctctgtcacagcctgtttgcattcttcttattgctgcttatgttacaccaagtagtattttaaaaactgtactaataaggtacattgatactaaaagcatttaactctattgtaattaacataaaaccataaaagcttgttttcatttatctgtcttgattgtatcaaaatggcaaattcttgataagttattctgaaatggatcttcatcatgttaatagcaacaagaaaactccattcatttgtggttttggcttcaggatatatgaaattataatgaatttaggatttttttcctgtatcactttgataattttataaggtgtggaactgaatgtaaggaaagaaatacagcgtctagtggattcacattcatttccgtcttttaaaaatattcatacgcaccttagtcttggctcatatggtcattaaaaacttttttttgtatgaaaactatgaaaggaatataaatctgcatttcttccaaaaaaagtatgtgaaatcttctaaacaaaatatcattaaaaataatcttatctttgtggaaagatagtctaattggatatcttatgacaagttattgcaaataaattttacctatcgacattagaaaaatgtttttaccattacgtcatgtttctttaccaatcaacctctgttgagatccctattgtaattaatatgtttgctggtatttctttcagttagattccaaatgcctcaagtggcggtaatttagggttttcccaacgtggtatataatttgcaagtttcaccgattttctgttttttcctaacttctcagtaattggtgccatcttgcactagactgacctaaattcccagagtacgtcaccaagcagctttcttatttaagacattgctactaatcttcactctgtaaggttttgtattttgcatgtggtacttatttagagcataaactgttcataggttgagactgggaagcagtactgtatcaagtgtggtttgatcagtgtgagtgactgaataaccaccttacagagctcaatgcagacttacttgaggatgttttccaaactcaatgagtaagtgattgagcttagatatgtagcatggtatatctgggagggtattggaccacaaaagcacatctgctttttcaatagttgcatttcaataaaataatttttattgatttttaatatgtgctttgaaagaacacttgtatgcatcctctcattatatgtaatctctgatacagttagtatagtctgaatgtagtgggaaaaagtttgtggattgccttacatgttaggaatactttccagtctcatcggtgtaagtaaatacatgataacttctaccttctagtgagtaaaggagccagggatttattactttatttagtttttttcaatgagcctgtttgttttaagtttatgagtatagtaaagttaactttactatttgattacagtttggtaacttgcatttcccattgcaaaggtaatggttacattctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggttacattcttaaatgcactcagtttatctgttttgctatcctcttttctttatatctcctttagtttccccacgttaacaataggattgcagctttacttatttgtattctgtacatctacatacattatttctaggatgaactccttgttattcattctctctctcttagatagcatttttcaaaccataacattttcttaaaaataagagtaggctaatttctttatggccccaaacaaaaacattgtatgataagacttttagttgatttttttacatcacttcattctataccttggtttggaataataccagaaaggactttgtaagagaagccagcatgtgttgtcttgtctgtatttctgtaactttataactgtattggccaaattatcagtcctgtttttagctacacacatacagagcagcagcagtgtttatccactacaaaatatgtaatagatgctctagaaaaagtcttctttaaacattgtaagtggtcaagttcactgggtttttttaaatgaagatagtaagtaactttacatttatcaagtatttttagccattaaggcttttagaacacaaatgaatgcctaaatgaatcccccaagtggattctgctgctttatggtggcttcagaatggcagaatggtcttacatgctttttgttcatcttaaatttaattatacagctttagtgtatttatcgcttatatttccttttctgatcaaagatacattttttttaattatttgaaaccacctttcatcattaatggagtttatttatatgaggacttgggtatttctctaacttttgatttcttaattctggggttttggtggggtgagctggtgcatagtgttgaatagttcaagttgataatcatattgtagttttcacataatacactgttatagtggtttactagatttgattgccgtaagcaaggaaaggaaattactttaggcttgaacctcacaggcttcccatgacccagcccttctgctagtagtcccactgacctgtccagtatggtatccccatctttctttgtttaactattaacgaggacttgcctactcttaattacacttacacattaactcttgtgaatcctggtagtgttttggcagatttcatgaaggtgagactacaagtattgtcaaatctctaaaaatgtattatcatttagacttttgtgaaactgttaacatgagcaaatatatgtttgaacatccttgcttttacatgtgtattttaatcatttttatttctggtacttaatattttcagatatggcaacttctgattcccagggttctcgtttctcaaccatattaatttttcttaataaataaataaagcatcaatcccagaaagaatttgtattatacctaaatgttatagtatttactacagtaggaattatttagtgaaaaagaaaaataccaagtagatcaattaatcattttgaggcttccatacaaaatgttcacttaatgtatgtattttaagagttttaatatgctttaaaagaaaatacaaaaataacatttttttcatgttatattcttcctttattataaccaacttttaagagaattggcagttgctacactgcttttatacactgcatatgtatcatgtgctttattacgtgactggagagattttattcttcattagagaatgcactatttttggttagtaaaatatattgagaatagatgagactgtaaagttagagaaaaaaatagatactagcagcttcactgcatttttcaaatgcagggtaaagttgtaggttaattgtggtattttctgttttgctttgattattctcagcacaatagtaaattgtattgtattggtaattcttctttagtactttatagctgatttccctaaaattaaaaatataaaatagaaaccaggtcatgttagaaatacagtatctaaagctttgataggacatagaaattatcatcttcaatttttttttaaaaaaacaaagattttattgttatggaaataatttattatgtcacagtcaagtgaaaactggcaccacaaagtaatttgatggctcagatgtaggtagaaaagaaatttaaatctgactttctctttttcttgaaaaattgtatttgataattggaataattaattaggtgtaggataaacttttctttagtgatgttatggatcttttcttagaaaacctaatattgataataattggtacaggattattacaataatgtttaatcgatttgaacatttatttctaatatttggtgattggcacattttttcttttagaagttcattctgtaacacattatgaagtatacagcagagatgtagcaattactttggagatggagagactaaataccaatttcacttattaatttgagggagagaaaactcacttggagacttcagttaggatatcaactctggatatcctctggatatctggatattttaaagaagtttatctcagtactaccattttataactaagtatgcactgtattgagtaataaagaaataggaattaaaatgtccttataaaggatgctttctaacattaaatctttattgtaattctgaaaattaaagtgcaccatttcttgaagctgcactgaaaagtcagcgctgtgttgggtgctgttgggtgctgctgtgacaggtgagagtccttgattgagactatgaagagctgtgtgcaaatgcttgtttgtactactaacaatgctatctttaacagcccatacaacctcactggttctcagtttcctgagttgcaaattgtatcacatggaaggtcacttccactctgaaattcttgaagtgcatgcgtctgtaatataaaattgagtttcagagtctgtcattagaatagtttttggcattttagatagtgatctctagcagaagttaatagaatgtgactagcctttatctcgcaccccgatttctatatgccagattttactttttctttccttgtgccctccttcttacaaaatgaagctgaagatgtttgtggcagaggtaccatgcatttttgtttggtgtacctctatattttttagtgaagagggtcttgagtaatgcccagttcttggactcttttgcccttcctccattcagttgtaatgcagttctgggcagtgacagggagcgtgcttcccagtgttgctcagaaacactgtgcctctttgaaggagctttcatttccacccgggagcatgtttattttcaggactttgagagaggtagttttagtcttggtaacttggtttgccgagagaaaaagtgatttgaggggatttaatgtaggtaacattacctagagcagtgattctcaagaatgtttgctgggagagggatggtggctgagaggacccatgacctgagaggggagatggcagactgctcaatccagactattgggaaactgggagctggggagttggccctgcagccactcacctggattcattgccatggtaagcccctgttctagacaggtaaggatcatatcactcaggcgtcctgaggtggaaaaacagccttggctctctgacatggtccctgaacacacgtgcttatactcacccaggaccatgtacggttccaggttcattacctatgcctttttcccgtaactcacacccgggaaagtacatcacaatgcaaatgagtgacttcacaggggtgacctttaatctactttaatttgtatatttaagatgtcattcacaaacttgtgatcatcttttttttttttttttttcaagacagagtcttgctccgtcgcccaggctggagtgcagtggtgcgatcttggctcactgcagcctccacctcccaggttcaagcgattcttgtgcctcagcctcccaagtagctgggattacagacatgcaccactatgcttggcttatttttgtatttttagtagagaaggagtttcaccatgttggctaggctggtctcgaactccttgcctcatgtgatctcccccgccttgtcccaaagtgctaggattacaggtgtgagccaccacaccggccttgatcatcattatcaatgcaattatttgtgacgtacttcctagccctccagagcttttaaaagaaatggaatctgactttaacttctagtgtttgaaagttttaaaaagtcccttgccatcttgcttttgagaaacgtcattagcgctgtatgttttgataggagtacagttgtttaattatggtagtaactgtaattaacttctgtctagctctttgtggcttaccattttcatatacattaattcatttctactccacaggaagcctggcattactgattatgcagccaagcagcagtgtactataatttgaaacctagtccccttgttccacataccctcctttctattctgtgaagctgttaatattgaacagacggaaatgagaaagtgaggcccatttattattttcttttctgatacctgttgtttaagatcactgctcactttttttccatgttccctttagatcttctcttatatattttgttccttcatgtgtcttgtttcctctttaatctttttaaacttttttttctcttttatttgctgttttattttgtgccaacataaaacattcttttgtaaggagttaataaagatacgcttaattttttatagaaaattctgagtatactgtttgagtcataccatgctataaaggtgcttaaattgggaaatgagtgagtgaacgtattccctaactataagcaactgttaaaaaagccagccaaaaaaaaagcaaatgaaagattctatagagaaaattcttgtgtatgtgttgtaagaataagtgttgaaagttttaatgtaaaacacactttgtatatagagtttttactgtcaaatggttaggtcaaaaaaatcctgcgatgttttttaaggatatgtcttaaatcttgtattctcaatcctagttatgtatttaggccacatgagttttgcagctgtaaccagaagtattttaatattcataactttcaatctttaacagaccatgcccaacactgtcatttttaaaaattaaattttaagacgatgtttgattagtcttttgactagaactaagaatctcaagcccacataatttctacttcatacattatttttaggagcattttcatttttgaaggcgtggtctttcaccatggggccccttcctgccaagtcttaataaatcttttaagtgaaatccagttaaagtgataggcttttaactagcttggttttaagaagtggaaaatcagtcaaaagcaggaaatctaggaaaaggtactgtgaaatagatataatcatgtatataatttgtatcctgcttgctctgcctcccagacttcagtgtcacctctccctgaagcctttcctgattttccctgggagagttgaccactcccttgtggtgtctctctgtacttagaaacatctgccagatcatctctgacacatccttccacttatttgttcaacagtctgccttcctcgagaccttaagtccctttaaggcagaagtcaaagtagtggctcaagatagagaaggttttaaatattaaaaagtaatctttcatacatgcttcattttctaagctcatctatggtattatggaacttttgtttcagttatgcatgtacattaatacagtgacttacaatataaaatgtacatcctctttgttttaactacatttttaaacttatttcactcttgccatttctatagaaaggcagtgataacacttatctcaacgggttgaggactaagagagtgaatttgaagcaaagtgagctccaggggcctcctctcatttagatgtatttatgctgcctacagtacaagattattcagttcttgattggaagtgaaatgaaggtcagcaaggtcagagaggcattttttaagatacatagatgggaaaattccccagcctttactgcttcccatctcttctgtcacactttatggtggcttgagttgaattagcgcgaggagacttgacatgttcatttgtgattgaaagtgagtgcaacatagtttggatgtttgtctcttctaaatctcattttgaaatgtgatcctcgctgttggaagtggggcctggtgggaggtatttgggtcatgggggcggttccctcatgaatggcttggtgctgtactggcccatagggaattctcatgtgagttggttgtttaaaagtgtgtgttatctgtccccttcgtgtcttttcttgttcctactctccccgtgtgacaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggcctatattcagtgggactctgagcttcaattttaaaagttaactgtggcttacaagttccttatgtcttgtacattttattgttctcattttccagcagcttgagtgctgtcttttgtaaggtctgctttgctttcaacactggctacagtatctttgggaatacaggtttgagcatgagaaatcgttatgttctgtattgttgctgtggttgctttacatacagaaacagaagtgctcatagctttattgctgtaaatatcaagggcttggagccatttgataaatttagaattcaggagagtctgttgtagcaagacagctaatgacctgaagagttctactaagggtcaatactaatgttgagttattgacatgggactgctttgacttttaactgttctgatgtacatttgatttggattctgaaaagataaattgacaccacataagtctactcccactgtcataaaagacatatctgcttgcaaaagatatagtaattaaaacataaaattaaatacttactgtaatttgccccagaaggtatctccattagactaaaaggacattttgcttatgcagattactttgttatatgtatcctttgtttaatgtaacttaattattagttataccattgataatgtccaaatggaagaaaaaaattgcctaagaacattccattccaatgaatgttttcatctttccatgttctcttccataattcttgtccacacataaattttacattattaagattatagagtaggtacttttttgtacagcaggagttttgatattaaacaattctcagatttctagggatttaaactgtgtactgtgatcttaccttcgcctcctccccagtccaccaggtaaggtgttggaaccttcatgctttgttaaactctggaaatgcaccttggtaacatcagtaccttagtgggctctctacttatactctgatttatactttgagttctgtctttttggacagtctcttcttattcttttctcattttaatatctttttctaggtgtcattgctgtcattaacaaactcttcatacttgctgaaaaaggaaattatttaatgtcagtaacaaacaattagagcttgagttgtaaagattctgtgttttttagttaattctaccattttgtgtaaagttttccaatctagacttgtgacaaagctgcttcttccatttaacccagtttctgtgttttatattcttttcttcttttaagatgaaatatttcaaaggagtgtcacactttagtgtgaatacctacctttttttcttctaagaagtacctgtatatgaggaatgatattgaatggagtagagacaaactttgactacacttttgttgttctttgtaattgagtagttaaaatgcctgttaaggacacttaaagtggtaactatggacattttgtagaaaaacagattaaattgggcacttttgtataatattcttaaataaaattcaaattgatgtgatcaaatttaagtgagaattgatatgtacggtacatttatttacttatttattttttatttttatttttttttgaggtggagtctcgctctgtagcccaggctggagtgcagtggcgcgatctcggctcactgcaagctccaccttctgggttcacgccattctcctgcctcagcctcccgagtagctgggactacaggtgcctgccaccacgcccagctaatttttttatttttagtagagatggggtttcaccgtgttagccaggatggtcttgatcttctgacctcatgatctgcccgcctcggcctcccaaagtgctgggattacaggcttgagctgctgcacctggcccatttattcattttttaaaaaactttttttgcttgaattttctgccacccttctgccctctgccctctgcccccatcatcgtgttggattgcttcactaggaatatttccagcaggctgacccagagctagggttcagacaagtcttttcagtgtgtacttaataaaaccaaatttgtgcaaggtgagaccagtcatcaagagataaaaaataaaaccaacaagccttggcatgagtcctctctggtggtagtggaggtggatggtcacatattaagaaaacagtgaatggcctttaaaattagatggagtgaatgaagtattgaagaaaagttgggctgtttatagagcctttagaaaaaagtaaagggaaaaaataaacaataggagtccaagttgccagatcattggtatttctgtaatatgaatgatactctaaagctcgtatgtgcaacccactttagaacgtgagaaccaaacagagaagattggtttgtgtgtaggagcgtaatttagttaatagatatattttgtagctagttatgtttctatcactcaattaatatatgtctttatgttcggggaggtggttcttttctatttgtgagtgacctttatgattggcttcctgatatgctgacaggccaggctttctagtatacatgggtgggatgttttccctcggttctaacaccatccaatgcaagtagcaccatgagatttagaaaacatttttgttcctgaagatcgatagacagcattgaacattgattcaactagtgtagcaattactgtacaaataatatacagtgccttggtttctcttctcataagcatttcagtattatgaattcagaaatgtgcacacagcagtgaattgtatcaaaagctagctttctggttcaaatttttacaatgtataataattttagttggtaaaatcgtttagtaacattctttaatggattagatcaaatgtaaaaaccagcatggaatcaggttttgtagctgatttataaataactgctgaaaacctcagggcttaaaattgaatttggttttaacagggttgaattgtatctgacacttgtacgtaacaactcagagagatgtttattaaagcgggttaataaacccactgagacatatttgaccattatttagaggaggtgaaatgtgaatttacattaaaaatggaaaagataaaagatctcagaaatataacatttttgagtatgtctcattctacatatatgccagtcttcctttctcatctttttattaaagttgcatatctattttagtcactttacatatttatcaccatctcctcggtggcctcatgtcattatcagttgatcttgtcacactgagcatcatctccccatctgttcctattaatatttcctcctttaatttcttattacatgggattgaaatgatataaaaactcactccctttttcttttctatattgttttgctttctttcttttctctttcccttcactcaagccaaaaggctgattcacagtagtcacaaaacaaaccagtgctcagtgagcagccattctttttccatcacagtgctaggcctcagtggctaacgagaaaggatcaaataaagaaggaatgtgtgaatgtgcaattatggtctttgtctcatggtcctttcataagtatagcatgttcattttcaggacaaatttgctccaaaaatttgccttttacctttcacatctcaactccttcagcatgtttctctggtcctgagtccttgtcctctctccttttctttccaaagacttgcttcctttaagacatctctttcagttttattatttattctggtaagttttagtttgttttagatggcagcagtattgataactgcacataaaataggtagtaaatagtatttatatttactatatggtttatggatttaaggaattaatttgaaacagcagttttgcttgaaagaggatttctaaatgaaagggtatataacaaataaaagttttgttctgctactccatttttaaacaaataattgttttattgttgaaattccctcctttcatctttggccagatataacaagtgactgttacgttatttcctactttgtctttagtgtgcaatagttttcaattaaaaaaaaaaacagactattgttaggtctgctgctctttaatgaatcattggattggaaaataactcattataccatcaggcagagatactttcctttatttgcatgtagatagtgaaggtgaataatttatcaaatgttattagtgcaggctgcatattactggagtcgcagcaggatataatgaaatttgtctcatgcaagtatgaaaatagcatgcctttgcatagtcattattgaattcttggcatctcttgaagaactattatgttagcatgccagtcttgctcacctcttcattaactgggcttttgattggagagtttaacttatcttgaaaatctgtggaatccaacatgccaaatgcttgcttgactttagcatgtttccatatcagagcatacattttcagaacgaataaagtactaaatgtttcttattaaagtgagtagtgcaaagaggctatgactgatggtgttattacttttggttgtgaaaagttgtaccggagatatttaagcaataaagctttctgaaatgacaggcgatgaaacatgtatataactacttagaatcttagagctgtacgaattatgtatttgaagttattttaatgattgctttttaaaagttgcatttaatatgcttctgtcgtgatggcatgaggaggtcaacaaaccttctcaaaagcaatgctaaagctgcacaagcagtcaaaagcaaatcatgtcagtactctggaaatcaactaaaagcattcaacaaactgaaaagtgtttattcatgaaaaaactgaactttggataaaaacagtgtaagtctgtggtattaatgctggggctgctccattttccctcctctattcggtgagtaaggttgcaactagggcaaaacaggccatgaaagccagcagcttctttgctgctcccaagacagctcagtggatttggagaactgtcaggttcagtggagattttgatggcaagcagtagggaaggtctgcggctctactggactgaagttactgacatgtttggtgcaagcaatggacagacggactagccagggttttagcagggaattctgggagctgagctagcgctatgaggcttgtgaaactctccacataccttcagttaaccagaagttgtttcttctgcacatgcagcagaaactggaatgggctttgtaagaaatactgaaagtttgtcaggcagaaaagaagaggcactgaatgataacttggattccaaggagcagtgaaaaatgctagaaatggtatttatatgagtaaacatatttttcacattttcattattaaaaaacaacataggccaggtgcagtgactcatacttttaattctagtattttgggaggccaaggtgggagtatcacctaatcccaggagtttgagaccagcttgggcaacatggcaagacctcatctctataaaaaaaatttaaaaagtaactggacgtggtggcgcacacctatagtctcagctcctcaggaggctgagatggaaggattgcttgagcccaggaagtcgaggctgcagtgagccgtgattgtgccactgcactccggcctgggcgacagagtgagaccctgtctcatagaaaacaaaacggaaaaaaacatacaattacgtaaaaaacaataattatagcaccatatttttagctttacatgagtctccccttaaccatgagagatacattccaagatccccagtggatgcctgcaactatggagagtaccaaaccctgtatgtaccatgttttttcccatacatacatccatacctatgataagttttcattcataaactaggcacagtaagagattgacaacattagtgagaaaatagaataattattacaatacactgtaataaaagttatgtgaatgtggagtgtctctccctgtcacaaaataccttattatactgtactgtgggtaactgaatctgtggaaagcaaaaccacagataagtggtgctactgtatataactgtatatgttaatatgtgtgccaatagcacaaaagaggaagaaggaaaataaatagcatcaggacagttgaatattcatattaaaaaaagagcttaggccttcactgtacataaaaataaagtgaattctagacataaatataagaacagaaacaataaaacatgtggaagaaaacacaggagaaatctctgtgcccttaatatagctaaagagttcttagatgtgacaccaaaagcatgagccataaaagaaaaaactggataaattgaacttcattaaattgaaaaaacatttacttttcaaggcacaccattgtgaaagtgaaaatataagccacagactgagagaaaatatttataaatcatatatctgataaaggtcttataaccataatatgtaaataattcttacaactcagtaagacaaatactctaattaaaatactgggaaaatactggagtagacatttatattagttgggaccaatgggtgtatgtatggaaagagacgtagtgtaaggaattggcacatgcaaccatggaggctgagaagtcccaagatctgcgttcagcaagctggaaacctcagagagctgatgtgtatgtagttccagtctgagttcaaaggcctaagaaacaggagagccaatggtgttaagttacagtccacaggctggcacacttgagacccaagaagagccaatatttcagtgtgaatctgaaagccgaaatggacctatgttctggctcgtacagacagtcaggaggagctcacttttagcctttttttttaaattgagacttttatttaattggacgaggctcatccatactgggaaaacaatttgcttcacccagtgtaccaattcaaatgttatctcatctagaaacaccctcacagagacgttcagaataatatcaaaatatccgtgtaccttgtggcgcagtcaagttgacatataaaattaatcgtcataacattctactgaataagaaatacatttggctgataatcacatgagaaggtactcaacatcattcctcactatggaaatgagtattcaaaccacagtcatataccactacacacccattagaatggctgttatcataagaagccgtagtactaagtattggcaaggatatgaagaaactcaaaacctcatacattgctgatgggaacattaaatggtatgactgctttcgtaagcagttgtttcttaaaatgttaaacataaatttaccacatgatccaccagttctactcctaggaatatatccaagggaaataaaacatatgtccatacaaaaacttgtatgtgaatgttcacagaagcatttttatggtagctgttaattggaagcaattcaaatgtcaatcagctggtcaatggattgacaaaattccctatatttggtatgtgaatagagatagactctgataagctcaattttagaacacttacatcaccccccaaattcttattttggggtgatgttccattcagttgtttcattcagttttagaacattgacatcctgtgttctaaaattgagttattgtgatgattataaaactttttttctttgagacggagtctcgctgtgtcacccaggttgtagcgcagtggcgtgatcttggctcactgcaacctctgctgcccaggttcaagtgattctcttgtctcactctctcgagtagttgggtttacaggtgcacaccaccacacccagctaatttttgtatttttagtagagatgaggtttcaccatgctggttgggctggtctgcctgccttggcctcccaaagtgctgggattacaggtgtgagcaaccatgcctggccaaaactttataaatgtatttaaaatcattgactcttactctcatagtgtgtgaattttataggctatgggatatacctcagtaaagttataaaaacaataggtctaggctgtgtgcggtggctcatgcctgtaatcccagcactttgggaggctgagacaggaggactgcttgagcccaggagtttgaaatcagcctaggcaatatagtgagaccctgtctcttaaaaaacctaaccttaaaaaaaaaaaaaaaaaaaaagacaaaatgcaatatgtccatatagaaagaaaaaatgacaaagtaaatatggtaaaataataattgaatctgaagggtatgggatttttttgtattgtattcttccactttttctacaagtgtgaaattatatcaaaattaaaaaattacaaatgttttaatggctcttaatagtgatctgatttccttttgtgatagtgtgtaaaaataagtttaaaatgtttgtttgtttaaaaaaaatccagccctaaagtataattttatctcagctttttgtttatttacttgtttgatttgttgtttgctttgagcagatacttggttttgcttttttttaattactcattttttctgcaatgtaatggcaggcaggcctagtgcccaagcaaacccttcctgctgcacatgcatatttggcatatgctagagagtatttatacctgtagaaatgatattttgagggtattctgtttctcatctgtgcaaatataagcaaagcaagtaggccctgaatacagctgtttttcttgttttttttcatttctttttctttttttttttttttttttttgagatggagtctcactctgtcacctaggctggagtgcagtggtgccatctgggctcactgcaaactccgcctcccgggctcgagctattctcctgcctcagcctcctgagtagctgggattacaggcgcccgccaccacacccggcttatttttgtacttttaatagagatggagtttcaccatgttgatcaggctggtctcaaactcctgacctcaggtgatccacccaccttggcctcccaaagtgctgggattacaggtgtgagccactgcacctggccactgtttttccttttgacagtatttctgaagtttaaatgatcacacttcactcttctatgttgtttcccctgctcccgaaaagaagttaaatgaacacatttgttgaaagcgttaagttacagtgaagtgtgtaactcttgctaatgtatatttatgtgcttgatttgaaggtcactctgtgagactgctgggtcagaaaaaggataatggaaggcggcttgggggagcacgattggatttgccgaagattaggaagaatccactgatagaaatcatttccatcaataccgggtaagcatctctcaaacttgctcataaaatattcaatatatttcatgaattcagtttttttttcttggacatgtgacatagaaaagtagctgaacattttcttgggaaagaaaaattacaaaatgtgctcaaatacagtttcttctgaaatgtttcctgtatgtaaactacacttatatttgcagcaggcttttataactttaatattattcccatttttggtaataaacataataaacatggatttcatttcccagctatgcccttacttaaaatctttgaaaaaagtagcactttattttgttgaatgattaagacacttgtcatattcgactgtttttttcagtaaaggtatggtaaatgttgcccaagatactaaccacgttttgattattcactatttgaaatgcatattttaaaatgttattattctgagctttaaacttaaaagaagcatcatgacagaatattaagtactcttttaatttccacaccttgatttaaagtccttgattataactcttggtatactcatttatactttgtttcatatgcatttattgaatttttgcattctttaaattatgagtccatcagaaaaagaaacattttctgaaaatttgatgagatgaagggcttctgtttcttaaatcacagggagcacctaattacccgtacaaccacatctcattccccacagatttaagctgttctgccccttttacttcatcctccttcccttttatttgaaattgttttccttctgttctgctctttcttcatgctccttctcattgagaaccggtgaacagcttccttgtccaccatctgcctgtttctctgaatccaatggctttacttcctccaggacagtggcggttgtgttgtcagtagccctcttttctgtagtctcaccactttctggtttatcctccacactgctgtcaaagactagagaaggttgaccaaagtcattcggtttttcccaaaaaaccccatggagtggcattcagtgacttggtgaatttgttgtagaccagcatctggccttcagcgttgaagattcagaaacccaaacttatcaagctcagaaactagtaattaaagcagaatttaacagtgagaagtacagttgtcgcttgactggagtacctcacatattcattctgtctgtctagcctgagccgaattataaatgcaaggctgtttgctttccccttcctcagttcttttttccccttcattcaaacattataatactttcccgcaactcctgattatcctatttaaaattgcaaactttctaacattccttctctttttctcagttgccttgttttcctctgtaactttaattggcattgaaatatataaatgatcatttatttgtattttaatggtctctcctcactggcatatatgctccatgggggcagggcctttttgattgtgttatttaccactctatccccagtgagtagaaaattatacacagtagggatttaatgcatatttatttattgactgaatgaatgaataagttttaaaatttgacagtttagtgggactatgctaaattatcatcatggtacagattgccttgcaaattggacaataatatttggagtttgctggctaatcacactttctcctgaaaaatgcagatttttttttcttttttttgagatggagtctccctctgtcacctaggctggagtgcaatggcgtgatcttggctcactgcaacctctgcctccgggttcaagtgattctcctgtctcagcctcccgagtaactgggattacaggtgcacgccaccatgcccggttaattttttctaatttagtagagatggagtttcactgtgttgcccctgctagtctcaaactcctgaactcaggcaatccacttgccttggccttcaaaaatgttgggattacaggcatgagccactgcacccagctgaaaaatgccggttttgtgtgtgtgtttatgcggggcttttggctagacacatgcctttaaaacattagtatttcagggtctgtcaaactctgttagattaggatccattaggtctctgcatggtaactttccaggtacgtatttggcctactgagtgtctgtttttaactgtttatttttctagtccctatgttcttcttcattttgtcactccctacttcacaccccagtattcagtcttcctgaactacttgaaattctcaaaactccagattcttctctgtcttgactgcaggcctccctgtaggttgaagggttttcctggcatgtctgtccttccccgttcacctcatgggtgagcctcctgcactcaactatgtgctcatttcttgggatgtctgcttgtttctccctcccaaccaggctaaatctatccctcactctaatttgtgtccacaacattccctatgtatcctgattatggcactttacacactatgtcatttgtatcttccactacaatgtaagctccttgggggctgaatgtgtttcagttgtcattacattattatctttgagttcagtgtttagtacaaagtgagtacaattgtccctcggtatctgtaggggattagttccaggacctcctcagatacaacatctatgcatactcaagtacctcatataaaatggtgtagtattggccgggcgtggtggctcatgcctgtaatcccagcactttgggaggccaaggtggatggatcatgagggcaggagattgagaccatcctggccaacaaggtgaaaccccgactctactaaaaatacaaaaattagctgggcgtggcggcgcgtgcctgtaatcctagctactcgggaagctgaggcaggggaatcacttgaacctgggtggcagaggttgcagtgagctgagatcgtgccactaaactccagcctggagatagagctagactccgtcttaaaaaaaaaaaaaaagtgtagtatttgcatataacccacttactttttcccatatactttaaatcatctctagattactaataatacctgatacaatagaaatgctgcctaaatagttgttatactgtattttaaaaatttggcttcttttaattattgcattatttttaagtgttttttttcttccagatattttatttctttttttttttttttttttttttttttttgagacagagtctcactctgtcacccaggctggagtgcagtggcaccatctcggctcactgcaacctccgccctcctgggttcaagtgattcttctgcctcagcctcccgagtagctgggactataggcgtgtgccaccacacccagctagcttttgtatttttagtaaagacggggtttcaccatattggccaggctggtctcgaactcctgaccttgtgatccacgcacctcggtctcccaaagtgctgggattataggcatgagccactgcacctggccccagatattttcaatccatgattggttcaatctgtagatatggcacacacatggatacagagggctgcctgcactcaataaatatttgttgagtaaatgttttataagttatgagttcttgttgctgtacattaattaaaaattaatcttaaaaatatttaaaatttttttaatgtttacaattttaaattttaaaaatttgctttaggtaaccattttcaatagcctttaggtaaaattttttatgtatattatttgaattttccctcttgtagacttaatgttttcttcaaatgggcctgctctttaaaagattgaaagctcactggatttggcatcactctcatcctcttgtatccttcacattagagtagagtgttgatcctcggtacattagcaaataatgcttttgatattaagaaaatttaatccatattgtcccagaatgagaaatgggtttctaattttctcagactgctaatcatcttcctgaatcagttgcagccttatcacttgctctcacatgaaagcattcccatacgtatttgtccacactatcattctataacatattagcttggatttctttttctttttttttttttttttttgagatggagtcttgctctgtcgcccaggctggagtgcagtggcacgatcttggctcactgcaacctccgcctcctgggttcaattgattcttctgcctcagcctcctgagtagctgggacttcaggcacacgccaccacacccggctaatttttgttttagtagagatggggtttcactatattggccaggctggtctcgaactcctgactttgtgatccacccacctcagcctcccaaattgctgggattacaggtgtgagccactatgcccagccagatttcatttttttcatgctggtggagctcattgctttttttcacttacttttaaatgttttaatatgattatactcataattatttttcagtagaaaatgagccttctcagtaaaatcctcacacttttcaaaattttattgcttccacattaaatatgtagatttcactttccataaatttttcatttttcgtttaggaaaagggtcccatttgtagcaacttttattgtatgtattagtaaattactgaagttactattagaaccattagactttgcaaagttgttatgccttgttatatttctagcttaaaatataaaagtatggctaggtgcagtggatcatgcctgtaatcccagcactttgggaggccaaggcaggtggatcacctgaggtcagtagtttgaaaccagcctggccaacatgctgaaaccctgcctctactaaaaatacaaaaattagctggatgtggtggttggtgcgtgcctgtaatcccagctactcgggaggctgaggcaggagaattgcttgaacccagggagtggatgttgcagtgagctgagatcacaccactgcactccagcctgggtgacagagtgagatttcatctctaaataaataaaataaaacaaaacataaaagtacatcagttgctttagccaaggaagaagttgaaaatttcagattgtataaattttggatgggcacagcaggatacggtgtgtgtggatatttatgtagaattttttaaaaagtcaaccaaatgttatggtcagtatcatagggagtcaacatgtgcatgaatggaagaaataagctaaggttgataagctgttttcgtcaggtctcccatttgtgtgactcccttattttttcttatctttttttttttttttttttttgagatggagtctcgctctgtcacccaggctggagtgcagtggcacaatctcagctcactgcaagctccgcctcccgggttcaagcgattctcctgcctcagcctcctgagtagctgggacttcaggcgcccgccaccatgcctggctaattttttgtatttttagtggagacgaggtttcaccgtattaaccaggatggtctcgatctcctgacctcatgatctgcctgcctcggcctcccagtgtgctggaattacaggtgagccaccgctcccggccttgactcccttattttttctagcagtgggaatacggtgtggagacgggtaggaggtagtgtaggggacaaaagtaaaaaattggaaattgtggcataaaggacatctgtgctttattttaccttctctgaccctatgaaagtcatcctttttgacagttctttggcaatttttatcttccaaagccaagagttagatgctgcttaacagttcttatataaattatatcatttttaagatactcctatcagattatccttagcttgaaggtttgaaatcctccctcaggcaaaacacatcttagaaattactgtctgaccctgtgatattttactgatactttatcttttaaaatttatcttgtctttcttgttatttgccatcagacagacatatggtggtaactgagaacctttaaggggaatataattttctttgagcttatattcttgaatttattatcattttaaaaagcatttttttccccctgtaacactctggctttgcgaaaactaactcatatttttacactttatgtctgtaatgtacaaaatttatcagttcctattccatttctggatacgtaggctatctacaaatatttgaatggatatttcaaactcattatttcattataacctgacaactcagctgtcagattataatgaaagcaagtcctagtccacagtctccaaccagaatttagtaagcaagctggcacggtccagctgttcttgtaacgttggtggagtcctcgttgtctctctttttgggtggtgaaatcaaactttgtatgaaaggttcacttgagccacatgaagcaacatactgtctcactgtagataatacatcctcaggcaaccagaattccttacctagtgtctggagtgagagtgtgtcagggaccaagccagaatcatatctttaatggtctaggccagtactaaccaaactgtgttctgtggaccagttaactatagattgttggtctgtgatgagtacacaaatagagacttttaaggcagtttaacgtcactacagtgagttataattcattttcactgtattttacacagatactggtttataagaggttggaagtaaaaatcctgctctgtcactatatatagtttgagaaacactgatttaggctagtgtgtgttgtaagattctttattctgttttggaaaatattttacccaatctacttatcttgagtgtcccttctttaactgagaccctatttcgactgtcttttatgctattaactacttgtaattagtagttgaccagtactttcaaaaatggaaacttattatttacatgctaattagcaaagcttctagtattgactaaagataaaagatagcttaaacatacagagcaatctcctctggaaggtggcctttctgattaaatactagctaagagtgtgactgtgcctaacagttgtagcttacatcaagtcacacaatttatatgatgttcactacattatattctttcaaaagtaaatgtatagttttcctaacatggctctcatgaaacttaaaatctaggtattataactgctatatttgcacaccgtaaggtgagtacagagctgtggttattattcatgttcttctgtaagctttatgggtggcaggaaccttaatctttgtcatgagccgagaatgtgacaccagcctattctggagaaggtagtagaatctataatacattggaaagagctctgcacttggagtttgtagtcatagacactttattttctagctgcatgacttgagtaaattaggtgagatcttagagatgatgtcttttctggcatgggtatagtgctacctactgaatgtatagcttagcacattaatacatattttctttcaaatcttgatgctgctgtatcttctactctaccgtcattctctgagaccccttctacccttgatttctttttattctttctattatttaggtaagaaatttgctgggactagaatgtgaggttacgactttatgctgttcaatgttggttcttcaatttcctatttcacctgttcagttttaagtgaatgtttgacaaacaaaaaaaattcatcttagtctctcctgtagctttcagcgcagtgtctttctcacagtattcactccataaatgtttgttaagtatttcacttgacagcagtgtttcttaaatgcagaaaaaattttctggctaacctggaatatagttcgaattgcttctcttactatagatgattgttttgtagaaaagagaatatgatagtttggactatgaatgaagtgaaagttatatgaaacaattaaatgtgtgaaattgaggcatttatggcaattgtgaactgcgtttttactcttttgtccacaaaccagttgtcctaaaatttgcagccttttttatgtcttcaacggaatcccaaaatatcttattttcactaaaatattatacaaatgaaattttaaagtaatatttatttctagtgcattataagactgtacttgggaaagatcattcataggaacagtggatggcactataggctcatacctgcgaagtaattatccttaagttgcagagctttcaaatgctggcttagtgaatgcttttaaagagagcagctcagtcaaaaagcttggacagtattaggagttaatgttatattttgtaaactttttaatcattatttgaaataaactttgaaatgaatatgtatataattttcttagttactagcatagagaaattactgatttaaaaaaacatttcaaattctagcatgttgtaggattctattgccctttctaaaaagtacatcttgcttatccgatttctaacaaaactatttaatttgaagaagggagaatgaatttggataaaaagcaaaaatttaaaggtactcaaatttaggcaaaccattaaagcaatcttagtttacagttaattgggtagaatggtcaacactttcttcaggttagttcatggagtggatatgcattgatagaacaacttagagatgcttttacagttgagaaagctcattatatttgttatctttaagaatcagcttatttatttcatatgtttgttctttaagaagaccaaagagccctgcaaatgaatgttgatttgtttttttgtttgtttaatttttttgtagagataagatctcactttgttatgttgcccaggttggtcctgaactcctggcttcaagcaatcctcctgccttggcctcccaaagctctgggattacaggtgtgagccaccacacctagccgggacatcaatttgttaaacaaatgtagttgaacataaaaagatgagttcatgtggtatttgcccttgagaatcccatagaaaagcacaaaacaataaagttataagcaacaagcacaaaacaataaagttataagctcacattgtatgacggattgtttagatgagttggagagtgcttccatggaaagtaatatttaggctgtgtcttaaaatatcttataggtggatttaaaggcaatttaagcactggtggggtggggggaaccaaaacaaaacccataagcagtggttattgcattgtgaaaaaccatgtcttacacagagaatgatgagtcactgtggtggtgttttgaataagggaatggtcggagaaaggtagcttgagaatgcttgggctccgaacttggtgacgctggatttttcgtggccactttgccaaccagagacctccacagccagtgatgccccctgatccaggcctcactcagccctgggcctaccactggaggcgccctgcccactcggtccacctgtgctatagcattcggtggttcccaagctcttgtcccacatccaagaagcatgagcttacactgacaattagaagggtgaggatgggcagagaagaattttcttgagtgatggaacagctctcagtggacaggggatgcagggggtggtccccccacccctgtagttgggtggtttctctctctctgtgtgtctgggtctggggctttttagggtctcagaatggggagtgcatgctgattggtttgtgagtacacaaaaaaggttaaaatgaaggcaccattcaaaggtaggcacgacagtgtagaaaaccaataaggaaagggtaggttaaagtaaaattggtggaggaggggggatcaatcagagggaagtgtgccaaatgagaagacaggttctcaatccggtccgtggatttgacttgtagcttggctttcaggctttaaactgtctttggtttgaaagtggggtttcactggggacccgacaccctctgcctaggcatttgtctgcctcctgctgctatcattggcataagttattcaacctctctataggtttcagtttcctcatttataaagtgatgatgataataatagtgttgtgagaatgaaaagaggtcacaggtttaatcagcacaatgcctggcacatagtatctgttcaatatatagtattattaactttattactatgatagctatgagaaggcaaacctcaggcttacgtagactgctatttgcttaaggccacagagctagtaagtggcagaattgtgactcgaaccacatcatctgaccagtttttttcaataaaccataacgtcagtggcctctagcctcattttctgcttctgggtctgtactgtagttgtttagttaattgaaaggaaagccacttagagctaaagtttgagactcatctggaagatagcctattaaatctgagaaacatgccgtacgcagcagagttttacagagagaatggggaatatggggctaatgtagtgagtctgtcaagtggaggtaggctgggagaatttctgctgtgtatctatgttgtattgtcagatgactcctaagatgcatccattttgtccaatggaatggaatttgaaattcctattatggttattttaaaggagggactgctaaatcatatagagatgtatgaccattgtgccttcctttcttgcctttttttttcccacttctactggagctaaggtgcatgaaagtgagttgcacttggaagggcacagtaggagcagatcattggatgtatccaaagagccaccatctgtcagctttcctgttgctttaagaaaacttgttttccagccctatcaagagagagaaaaaaaaaaaccctgaaacttgtgtagcccaactttaattaagtataattgaacacacatgtgattgtggacgagggcctgtcagttttttccaatacaagaataatatatatcccatatttatttttgaaaccactttgcttttatttgactgcatctcagcatggtagcaccagttgttttatttttttctaaccctgacaaagcagaatgttttgtttggctttttaaaaaggcaatagtgcatgtagttaagacctcatttactttatctgatgaaacagtctctgaggagtgtctattttttggtaaatccactaagaaaactgggtttaaaacgaggtcatttttaaaaatactggtttcagtttttaaacaatgtatgtacctttgtgatttgtaatgtatatttttgtggttctttttaggttaaccttaaagtaagtattaattgtgagatcatataggtttacaaagttctttctcccttgtgaaatatattttatgtactgttctgttactgctcttgcggaaaacataaactttctgaaatggaatttttagtccgttctcctcccccactttctcctgtctctgttatttttttctatataagtttatgagaacaagatatgcaagtatggatttatttatttaggaccaggagccccttgtaactggaagatatcctctatcaagattggtggtctgttttattcattggtttgttttattctctactcattcactcatttactcaacagaaatttgcagaacatctctatgtatctgaaaatgtactaagtgcaataaaagaaacaagacctagtaatgtatcactgctcttgggagccttacagtctagtgtagtttagttaactgggaaataattttgttttagtctacatggaatataatagtagttttatatgtgtaggacttagagttgtgtacctagaagtttaccacaaatatggggaatgtatcagacttgtttcaaatgtgatagctgaaaataggctcatacaataatggtgtacaacatgtatgtcatgtgaaccagcagcacgttctttggtaatttgccactattgagaattctgtcactagcatcacatattgttctcactctggaattcagtcaacccgggatcctttgagtgtagatttctgtgcttactcctaaaattaacgcccctaatttcacttccaaaaaagattgcaattgttaaagcccctttctgtctacttcaactttctcattcttatttctactattggtcttatttttaaaattttcctaccttaattctcaattatatgcaaaggaagaggcaaagcaacaaaaataatgacaaggtgtcagtagcggcgttgatgttgacacattgcacgcatcttggaaaaagagatgtcaaatgcccatgaggatggagtatggttgagattctgctactgctgaaggcaaattttcctgttgtttccatgatgcctaataatggcaacgtgatggttggcataatgagagtcttctgtataagtgagttgacttgcacttaaatattttgcagttatttgtcagttatttatcaaatgattgtttatcaaataatttatcaaataattaattttcttaattttattggagatttgtcatccaaatgttacatttggaatataactaacatactttaatactccattaagtttcaatttgtatggtagatattcaaggatgagtgatggaagaaagaataatatagacatttcagggattgtttttttttaattttaaatttaattctttcagatatatattatatatatatatatcctaattaggttatatataatatatatatacatatataaatatatcctaattcaaaatctaactgtgactgagactcatgcatagaatattttctgatgtactttacaaatgcttatttgaacagcatcagtatggcttgcctaatttcttagtttcttttgtttatcccaatactgctttgcttatacatatatatcttaaaggtttctaaacttagagacctgtagatcctagacggctttaattgactgatcttttaatgtctgtattttctgttcccttatcttgtagttttttaaaatccttctttaaattattgttttgttctcttatttttccattttctgtatctgctttttcttttgagcccacacttttgacttttatgtaagaatcatgttttattaaaagcctctttttttggtatagtaggtgagaaagaagtagttgaatttaaatatatctactgtaaatatatggatttgtcttttgtaacactgccttgccaagtgtttggatagatagtagagtagcatgacagttcacacagtgagcaacagtttgatttaagctatttgtttatgtgctacactgcttaaaatctcttaccagctaatgagaatgatctgaagactttttttgtaagagatgggaaaaaacccttttaattaggggtagactttgtaaaatacttaataagtttctttattatttgtagccccatggccaaatacctactacccacacactttcttaatacaaaactattcatagttaattaaaaatctttttggcagattcacatattcatagactgttagagctagaaaggattttagagatttaaaatcttttcatagatgataaaactgaggccccaaggactaatgtccgaaagtttggtggcccacagattgtactcacttttaggagaataaggttcatgacaaacagaggttactctcacaggtgatacaccttcatctttaggattttaggggtcagtgaaaggattagaaagcagattagattttgtttgtggtctgcaagacatcataaaatgatatttgatgttagtttgtattgaaatatatgtaggtcaaaataccagaaactggtatcactgtgaccaatactgtttggtggatcagaggaaaacagtgagattatctgtcaagtgaatttgattacatgggataaaggcactattgagacttctgttttggtgtgagagcacctttggaaaaattctggacttcatatcaccttgttttccttttctattcactcattatttacctttcccatccacacttctggttctgccatttaccttcctttaattcctataggtttatatgtttgtatttctagtacctaatagttactagctcatagaagctctcaataaaaatgtttttacgactcagtttctaaatgctaatggtatgttttcattctaaagtctcttttgctgtttcttgagtcttgaatctctattccagcctttctcagttcatgttttctgagagaattaagcctaaacatatgtgattgaatgtcctaaggcattcattatttagtgaattaaccttctcccaagcatctagaatgatattagctgcatactatccttgagagaattaaaaagtagtcactcagattattttctgcagtgcataattctcttggaatagtggttgagaaaggctgatttattcactttatcagatattccaaataaccatcttaaagcttacttttctaagaaatgccatcattgattgacttcattttaattgttcttttacttcacattttcttagtacatagacttaatttttactaacggctgttgccaagatggtgatatgctgaatgggttatagtaaatttggtttattctttaaaaagaaacataaacaaaaagtatataatagatttctcatgttgctattttttctcttgaaaagcatatactacctgagtgtcaaactggccagtgcttgggtgaacttctatgtaaggcttgttaggtctgtgatgacacaaattccaagggcaaaggaaagagattggaactagtagatgcaacatgtttaaagctgacttggccagtataagtgatccttgagaatcagccctctatttaggcatggcatctaaggcttgtaactgcctgggttcttatttccaaaggagtcaatgttagatataccagggcccagatttatgaaaatacagaaagaaaactgtgcctattcacagatgatatgactgtctacatagaaaatctcaaggagtccataataaaacttctggaactcataagtgaatatagcaaggatacaacataaacccataaaaataaaacatctttctgtataccagcaatgtgtaattggaaaaggaaatacagaaattatttatgttatgcaatagctctaagaaaaatgcttagataaaaatctgacaaattatgtataggatatgtatatggaaatttacaaaacagaagaaatcaaagaagatctaaataaatcatgcaatgttcaggaattggaagattcagtatagtaaatgacaattctcaagttgatgtatagatttaaagtaatttgaatacaaattccagtaagatttttcttgtagaagtggagaaatggatgctaaattttatatggaaaggcaagggaagtagagttatctaaaacagttttgaataagaataaggttggaggaatcacaccatcctagtttaagacttactgtaaagtagcagcaatcaagaggtgtggtagtggtgaagggatagacacattaaatcactggaaggagactaacaagtccaggaaggtcagacccatgcaaatatgggcagttgattttgacaaaggcgcaaagttcatccaagggagaaagcagtgttttcatcaaattgtactggagcagttgggtatccatatggaaaaagaacaaaactttgacccaaatgttaaatgtatatgaaagttaacccaaaagggatccaagttcaaaatgtaaaatgtaaaaccttttttcttattcaattcatgaaaataaaaaataagaggtaaaactttaaaaattgtagaataaaacataggagaaggtttctatatttatggttaggcaaagagttcttagacctgatacccaaaagtatgatctataaaaggataaaagatggacttaatcaaaattaacaacttttgctctgtgaatgaaactattaagataataagaagcaatctgcaggctgggagaacatatttgcagatcacatacacagcataggacttgtatccagaatatataaggaactttcaaaactcactaggaaaacaaccagattaaaatacgggtaaaagacttgaacagagacatcacaaaaggggatatgcaaatggaaactaagcacatgtaaagtttttcgacatcattaacatcagggatcctataactcacctattcgaccaagtaaaatgaaaaatattgatagtaccaggtactggagaggatgtagagcaattagagctctcatacattgttgttggagatgctaaatggtacagccatttggagaatgaattagcagtttctctaaaaagttaaacatgtacttatcatatgacgaacgtcctacttttaggtatgagaaatgaaaacgtaagttcacccaaaaatctgtgtatgaatgtttatggcagcttccttcctaattagcccaaactgaaaacaactcctgtatcctttagggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgctttattttattttattttattttattttattttattttattttattttattttattttattttattttttcttggagacagggtctagctctatcgcccaggctggagtatagtggcgcaaccacggttcgctgcgttctctgtcttctggggtcaagcaatcttcccacctcagcccccggagtagctgggactacaggcatgtgctaccatgcctggctatttttgtattttttgtagagatggggtttcaccgtgttgcccaggctggtcttgaactcctgggctcaagtgatcttcccacctcggcctcccaaagtgctgggattacaggtttgtaagccacctcacctgccctatattatttatttatatgacattttcaaaaagaaaaaactatggtgatggagaagagatcaaggatttttaggggttagagattgggaggtgaggagggcagagagtgtttgggtaagggtatagcacaagggaatgttctagggtaaaagaactcttctgtagtcttttgatgatggttgcacataccaatacataggctaaattcatagaactgtacaccttccagaaaatgaaatttatgtcagttttaaaaaaattattctgtgaagaaaataatatttattaagaaatatttaggtagagaaccagggtagattgaaaattgtgttaaaagcatgcacacgtatgtttattgcagcactattcagaatagcaaagacttggaaccaacccaaatgtccatcaatgatagactggtttaagaaaatgtggcacatatacaccatggaatactatgcagccataaaaaatgatgagttcacatcctttgtagggacatggatgaagctggaaaccatcattctgagcaaactatcacaaggacagaaaaccaaacaccgcatgttctcactcgtaggtgggaattgaacaataagaagacttggacacaggatggggaacatcacacaacggggcctgtaatgggatggggggaggggggagggatagcattaggagatatatctaacgtaaatgacgagttaatgggtgcagcacaccaacatggcacatgtatacatatgtaacaaacctacacgttgtgcacgtgtaccctagaacttaaagtataataatacaaaaaaaaaaaaaaaaagaaaagaaaattgtgttaaaaggtttgcatctcatttaaattggaacaaagtcatctggactgagaggaaaatgggcctgggcccatatatttgaaaagaactgagtttttttttttttttttttttttttttttgagacggagttttgctcttgttgctcaggctggagtgcaatggcatgatcttggctcactgcaacctctggctcccgggttctagcaattctgctgcctcagcctcccaagtagctgggattacaggcacgcaccaccgcacctggctaattttgtatttttagtagagacggggtttctccatgttggtcaggttggtctcgaactcccaacctcaggtgttccacccaccttggcctcccaaagtgttgggattacaggcgtgagccaccgtgcccggcctagaactgagcttttgaactgttgctaagggtaaattaggtatcactgaacttaccctcagtaatgaatggaatatgtcacctgtgggtaatatgcgacgattaataagacagttaccacacctactgtataccactaaaataataaataagaatttttaaaaagacagttatatagcaggattatgtcgtgatttgacttattatataaaaaatttaacgtatgattttccattagaggaaatactcttttgttttggcaattcctgccagtctccatttgttgatcagaagacatctttcagtagtattgtattgctactggaggtaggattgggccaaggtggaatctggttagaacaaaaatgccacagaagaaaatcatttggcttaccagtaagctgatgtgtgcatcctccccttaccttcgtgcacatgtgtacaccagacttgcaatttgtcttgatgctttgagtagagaaagaaataattattgctttggaacttgtgcctataaaaactgtacaaatctaaaagtacttggtcacttgtactcatgatgatttgtttaaatttacccttttgcatgttagtagatactgcgaaatcttaatcaggcccttatatttaccattgaatcatcttagccatatatttggaagaattgcaaatcccccctttgcagggctgcctatgaaaatctatacaatggaaaagcaacagcatggattccctacaatatctcagagcacccagccctgctggaactgctggaccagcatatacatgctcagcagcctttttcttttcttttcttttaaagcagattctcatagcagctttatttgcaatagccaaaaatgggaaacaacccacagtgtgagatagggttacaatagaatattccccagcaacataaagaaactaactctgggtacatgcaaaagcatggatgaaactcaattatgcagagtaaaagaacccagacaaatttatgacacactacattattccaactaaactgtagaaaatgcaaacaaatctctagttccagaaagcaaataagtgaatccctgaggcaaattggtctgggagtggggaagggaggaattgcaaaggtacacaaagaagctttgtagggtgacatatatgcccattgtctcttatgatgatgttttcatatatatgtatgaaacacttctaaactctcatgcccagcttttaaaattcttttgatacttactaggaattttaaactaatttgacatccttcttttttgagggtggtgggggatagagtcctgctccgttgcccatgctggagtgcagtgacgtgatcatggctcatggcagcctcgacctcccatgctcaaataatcctcccacctcagcctcttgagtagctgaaacaacaggcgtgtgtcaccttgcctggctgatattttatagagatgggtcttgctatgttgcccagcttggtcttgaactcctgggctcaagagatcctcctgccttggcctccaaaagtgctgggattataggcatgagccaccacacccaaccaactctttctttcttttttggggtaaacaggtcttgccctgtcatccaggctggagcatgatggtgctttcaaggctcactgcaggcttaacctgccaggctcaagcagtcctcctatctgagcctaccaagtagctgggactatgggcatatgccatcacacctggctaattatttttatttttatttttgtcaagacagggccttattatgttgcccaggctggtctcagactcccgaactcaagtgatcctcctaccttggcctctcaaagtgctgggattacaggcatgagccgccattcctggccccttattctttcatcttgggtttttccctgaagaaattttctatcctcatctaccaccttaggcttgctaacgaggctctgcagatgaaaccatagcaggcttttacattttttcccaaaattttattatgaaaaatttcaaatggacagcaaagtcgaaaaaattttacagtgcacacctgtctacccaccatgaagattgttattaacattttaccatctttattatgtcatatctttcttcatccatttctattcatccatcagtccaacttatttttttaacatgtttcaaatgaaattgcagacatcagaacacttcctctaaatactacatcagacgtgacattatagacatcagtatttgtaggattttatgtaaaattttgaaaccatggaatatatacatcttaagagcaagcacatggctgagtttcgacaaatgcgtatgcctgtgtaactcccatctctattttttaaaaaacctgtgaccagatagtatttacataatttcgcaatggaaatatagtaatccccctgatttataaggatgtgttggtaaatagtctgcattttctgtgttgagatcaaagctgtaatcccctccctgtctttgtccctatagtgatggaaataatagattattttagcccaatgtgtaacatccttcttaaatgtattaagaattttaagtgtgctattatgcaacaacttgataaaatattttcttaaaatatgtgtttttaaccacatgcaatatttgctgttaacctttaaaaaatatgaatgacggccgggtgcagtggtggcaaacgcctgtaatcccagcactttgggaggccgaggtgggcggatcacaaggttaagagattgagaccatcctggccaacatggtgaaaccccgtctctactaaaaatacaaaaattagctgggtatgttggtgcacgcctgtagtcccagctactcgggaggctgaggcaggagaatcatgtgaacccaggaggcggaggttccagtgagccgagattgcgccgctgcactccagcctggcaacaaagcaagactccgtctcaaaaaacaacaacaacaacaataataataataataataataataataatgtgaatgagttatttttctttagcaaatcattttcttcatattactttctaaaatactgaaagtatatgcatgtcctcaccctatagtctcaaaaagaaagaaaaacatcattcctactacagtactctcaacctttgtatctattgtttgattaggcaaatatatatattttggagatatatatgtgaaatatatacatacacatatacatgcattcttatatgtatacacacacatatataagaacatatatatgttcttcaacataagcattctttccagttggatgattgcaaaggggtaccacaaaacaggccttacagtgatttaaaaatgctttgagtcacaggcatttacaggtagttcagtagaaaattttgatgttcgtttcaaaaatgcaaagcatttctcagagcacagaaagatgattgtgaagaaatctgaccctgaaggccagtgagtgggtggggcttagacatcttaaatgtcttagattactctgtgtctgcagaaaacttttttaattggattgcaggaaggagaagagtactgctgaaattaccaggaaagaacatgcatttttaaaatgcagaagagacatcctaacatgttatcttgacagatgtcaggattatttggggacagtaatgggcttgacctacaaggaactgacagaatgtctgaacttaatctggaattatattaaataacctgaagccacgtttgttgccatctctcaagtgtataggattgaaattgtgaaaacttttttacttaatatttgcttatatgtgggtatacatttgtgatagggttccagagagtttgcaaacaaggtagaggaacagtgttattaggaagattaccaactccttagggtggtataagagtcccatggcttcttccagccttttctctcctttccctgttacaactaatactcatcaatgccagcctgcctgtctcaacataccattctgtaacatgtgttaatgcccttgtgtatgccattacttctgctaggcctgcttagccaactatagtcatctttcaaaactttgtcaaatatcgccttttccatgtcaagtgtcaccatccttctcaaggaagagttgttaatcacgtttgtacaatttttatcataatatattctcagaagatgcagagaggagaataattgagaactaaaaataagccattggcggtgatagtaaagtgttcatggtaacctgacagcaattccaggagagttgtttaggttaaatgcagattgacgtaggtggaagagtgggcaggagatgaggcatagggacaagatagtatcttttaagaagtttgttgccagtgggaagagtagagatggggctctagttggggagaatcaggggagctgatgttattcttgtggttttaggaatggcagaaatagaaaataattttatatttaaaagaaatagctactgggaaaagagagagaccaaataagaagtgagactatttggtagagtaagtttccggagcatatgggatcgagaatgtaggtggaagtgcttaggataatataacacttctaccttcaaggcaggaagatgtgttgacaagggtggatgaattttcattatttttggtcctgtttagggaaaaagaaaatgaaatgtgatatttatatcattggtcaacaattttccaatattatatatttaattattttctcttctactgacatttatggtattctgttaaatctttgaatataactacactataacattttacaatgactatctaccaatttgaaaaataacttgaatggtttaagaattactattaagtcattcagtaaaaatgacttaattgagtgcatactattgtgccagctatgatggtaggtgtacggatacaatgatgaaatacagaaacagttgtgaattagttgtaaaaattcagaaaagaaacaatggtagtatgaactcagagagagaaaatagaatgagagaggcaagaataactgggactaagaatacaggtgatcggttagttcaaggattaacaaactacagcctgtgggccagagctagtcagttgcttttgttagaacagcttgtgatctaaaaatagtttttacattttttaaacagctggggaaaataaaaagaaacataataatttgtgatacatgaagattacatgaaatttaagtttcaatatccattactatttatggatatttttaattttatcaggaaacagccacattcactcattttaaaattgtttttgactggtttcatgctgcagtggcagaattgagcagctgcagcagacagtatctatgatgttgtacaggaaagagtcaatagagcaggtctgggctgccatctttagaaggatctgcttggtactggggccatgggggtgaggttaaccattgagtagtatctgggagcctgactcctagaattttccctaagctgataaaagcatttttcctgcctggagtacaaacgcctgctttccttctgctagtctactgttttgatagttgtgactagtcatcataactctgtgaccagcccagaataaaagtcctgttgtttgagcccaggtgtttgaggttgcagtgagctttacttgtgccacttcactccagcctgggtgagagagtgagaccctgcctctaaaaaacaaagaaagaaaaattaaaacctgggattctgagtctctaatgacctgctctaggtagaaagatcatgtatgtgtgttactgcatttcactgctggatggactgtgttctgtatggcttctcctgagaggtaaagcacaggaagcctgtgcacagattcctccagattttacctgatgtgtctttttctgttactaattgctgtactaaactatagccatgagtgcaactgtctcctgagtctgtgagttcttctaatgagtcaccgaatatgtgtgttagtatctagagacccctgaaactggagctttcattgtttgcaatgctggtcagcacactataaattgcagttacaactaactccacagtgttttcagtggatgtatatcactgtttttattttactttattttttattagcagggcatacccatcatgccaaaataaaagcatagtttgaatatctcacttttaaggcacagtggagtgaggattactttgttatcaaattagatggcaaagcgttgtgtttattatgtggtaactatagctgtggtaaaaataatacaatatgctttaacattagcagactaagcattcatcacaatattcccaattcacaggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtcttattcttttttaattttcaacttttaggttcagcaatgtgtgtaatatgtacaggtctttatgtaggtaaattatatgtcacaggggtttgctgtacaggtaataagtgtagtacctgttaggtagtttttggatcctcacacttcgcacatcctctaccctcaagtagcccccagtgtctgttgtttctttctttgtatccatatgtactcaatgtttagctccctcttattagtgagaacctgtggtatttggttttctgtttctgcgttagttcgcttaggataatgtcctgcaactccatccatgttgctgcaaaggacatacatgaacttattctttttatggctttgtagtattccacataccacattttctttgttcagtgtaccgttggtgggtatttggattgagtccatgtcttttccattgtaaatagtgctgcgctgaacatacatgtttctttatggtaaaacaatttatattccttttggtatatatgcaataatgagatttctgggctgaatggtagttctgttttaagttctttgagaaatcgccaaactgctttccacaatgagtgagctgatttaattcccaccagcatgtttaagtgttctcttttctccacaatctcaccagtatctgttaatattagactttttagtaatagccattctgactggtctgagatggtatctcagaccagttgtgagtcaacagatttttctagtactattcaattgttgtttattagaggaggcaatgatgagtttgaagtgaatgaagaattagcttatctgaataccttatgtggaacaactacaagcgaggatatttacaaggaaattaataaagcattacttagttcaagctgaagtggaatctgctaagatgtgttacagctgatacggtaaaaatatgtgtgaagcagaacaagtcttagatttacaaatctgtgaaaatgtagagtgtttaaagcatatgttcattgtattattcgtcactagatactgatgaaagtatttgtatctgtcatgtgctgaactgaagtgtcattggtgaacttcatttcatttactcatgaagacttagcctttgtcagttctgggaattattgtcagaaactgaagctgattattttgacttgctctaccacacacagcagtttggtggtttagtaatggcaaagttttactgttatttatttatttatttttgaggtcagggccaaaattgattttttttttttttgagacggagtctcgctgtgttgccccaggctggagtgcagtggcacgatcttggctcactgcaacctccaccttctgggttcaagcgattcacctgcctcagcctcccgagtagctggcactacaggcgcatgccaccacgcccagctaattttcgtatttttgtagagatggggtttcgccatattggccaggctggtctcgaactcctgaccttgtgatcggcccacctcggcctcccaaagtgctgggactacaggcgcaagccactgtacccggcctgaaatttttctgaatgaaaagaactgcccttctctactgtttctgaacactaaatggctttggaaattaggttttactggagactttgataatatttcctaataaaattaatccaaaattaatccaaaattaaaagcaaaatggcacttatatgtaaaacatattactgtaaagtcattttgatagcaacgaatattcatgtcatatgtaatatcaagctgctttctacacttcatgtgccatcaaaagttaaatgaagaagcaagctctttattgccttccaaatttgcagcagataaatattctgagctcaaactacagcaacagttttttggacttcaataaagagcaaagtaaatttctgtacttcaaaatccatttaaggggtgcagtgaggaactcacacctaatcttcattgggattgattaatctgtattgtaaatgacatgctgaaaggtaaatatgaagaatagaatactatagataccttccaagtgatgaatttgctcagttaaaatcacgtttgttgattgctatcagtatttgccattacttatctgtgtgaaagacattttaaaaaatgaaataagtaaaatctcttcatatgtcaatattagcagattaaaatttgtaattaattttgttgctagggcattttacctttgaacccaaattaagtaaaatattattcttccacagagaaaaaattctattcttctccttaagagatttgtattacaaaaaattgcatttattatttttattattttattttggatgttgtcaatgaaaagcttatggtaattgttttcactcttattatgtaagtacctacataataaccttgacattgacttttggcctaggaagtctggtgatgaaaaatatttactatctgtttctttaaagaaaaaaatttgccatctttttgttagttgattggatgtgcaaagggggttgatggaaacagggagagatgacgcccacagttcctggctggagcattatagcagtgttcttgcagacaaggagttcagagggaagaggaattttggtagtgggacaaagataagttagttgaattttggatcagtttttgagatgcctatgggagattttcaacagttggttgaaaccaactgttgaaaatttggttctgggtttcaggagagaagatgggattggatgtatgtattattagtatgaggtagtaacagaaaatatggatgctattttgatgtatcctgtacattatacttatttcgttcacaaaataagtatatttttctactgtgttttctattttgaaacaaggctgatttttcactgggctcctgaaatagactctggtcactaagtaactgctgtctttgattttgtgttgagggagctgtttcagattctcttcttgactacatggcataattctcttttactacatcaaactttaatttttagctataacacttgaagtaaatcttttttgaaggcaaagaccatacatgcattttggctctattaatattgcttgcagaaaccacagtgtttttatcagagggaaagcaaaaacttgtttacagtggaaagcataacaaaatctgtgatctttttgcctgaggactctttccaaaacaacttactgtaacagacatctaaggtcagtatttcctaattaagacttttcagctacagctcccaaccccagtcatcactcacagggccattccttccttaacgcagtgggtatttcaagttattagcacccaggggccatgcgtttcttcacttaatatgttgaagaattttgttctacttcatatcactaatgatttttaacttttttgggtgtctgtttccaaaatcaaatttagaagtacaacaagctgattaggtatcactttttgtagccatctgagagcagaggtatcattttttgtaaccatctgagagcagagaatttaatgtattgatattttactacacttggaatgatttttggatctggagtagttgggaatgaaacccttgcttcctggccttagaggaggcaacatacttttttccttttttttctgttctcatatgctttccccagaatgcatcattctagtgaatactcagtaaatatttgttccattgaattgaataaaatgagcaaaatagaaggctaacaattgaagaataagtaaacgtagaaaggaagaagtcaattcaaagatgagttgctctacttcttgaagagtgtatcaagtgacagaaaatcagagattgattggtgtatcctgactttttattgtattcttagctggtttttgtctcttttaagatatgtaacttccttaagatatttttacttttaagatcttatgaatagaaattattcagaagtatttactatatttagtattcaaattttaacaaatacaaaatggaaaaacaagcatcaagttggtttaaagatagatgaagacatttctaaggaggctgaatcacatctaaacttttagatggacagccccgcagactgatagtgatccttcaattgtgtcctatttttctaccctctgctcttccacagttttaactcttttaaaccattatagaacacttcaaacacatagaaagagaagatggtataatgaaccctcaagtacttacctagctgcagcaattatcaactcatgggcaatccaaattattttatctgtcttccaccacccttgccccttctcttgccccagcacaactaaattgttttgaagcaaagtgcaggagttgttgtatcatttaattagttaatataccagttatgtgtttgagaccagcctgggcaacatagtgagagtctctctctctctctctctctctgtcacacacacacacacacacacacacacacacacacacacacacacacacacacgtggtgtcatgttacgcacctgttgcctgtggtcttagctactcgtgaggctgaggtgggaggatcgcttgagcccaggagttccaggctgcagtgagctatgatcattccactgcagtctaacctggctgacagagtgagacactctctttttaaaaaaaagattatgtgtgtatgtatgggtgtgtgtgtgtgtgtgtgtgtgtgtgtgtgtgtgtgtaatatattgctaaaaaaaaaaagtgtttattcattctctctcctctctctggaaaacaaaacaacccaataacattgtcacatctaaaataaaattaattaggtttccttaatatcattaaacatctagtcagtctccaagctttcacagttagtgctcttgttcattcgccctctttatctccttttctcacccaccctacccccagtatttacaattctttgttttgaattaggacccaaacaagatccctgcaacgctttgggtctgtgccaccacagctctggttctttgtccaacttggccatcagacttgtaagactgaaatggcttcaatactatttttatttagattcatgtaaggaatatgagcaggagacatagcaggtacaacgtcttcatctcaggaaacctagcagttaccctaatgtacagctcttttctcatctaaatagaatattttgactgccatggacaagagccaaggtgtgtggatgctaccttatcaagcaaagacccagccttgatttttcactgattttttaggtcattttagttaagtaggcccaaggcctgtgtaccatttcctagctttctccatccggggcaattctatacagcagatgaggctgacttaacattctgcatttatcttaattctgttgttaccaaggagataaatgtcgagacgctgaggtcattcccaggaaagtctgactcagccctggcgaatgttaaccctttactcaccttgtgtcttaagtatctttttgtctgttgtttcatttttttctttcttcgttttttgcagtttatttaaggaaaccatttcatttgtcctgtagttttccacattctggattttgctaattgcatcctcatggtgttatttaatgtgtgtctttatccccagattgtgttgtaaactggaaatcaaatctaggcacttgaccagaattcagcattatggcaagcatgcttcatagctggtgctgtacactgcatattacatcataacagggtctcatgtctactcctcttacttttgctaatctgcgggttatgtgttgttaacttgatccagcctttgtaagattttatcaattttttacctagtagtaaaaaaaaaaaaaaaaaagcctggactgttggctcaattaggggcagacaaacatattctgtaatgggtgagataataaatattttaggcttgcaagtcacaaaaatgtctatcaaacaattttgtttctttttacatccctttacaaatataaaagccatccttagatccctggtcatacgtaatcagggtataggccagatttggcaagctggctatagtttgtcgacctctggcctggatccattattttattaaggattgcaaaattttgatattttaattttattgcttcttcatgttttagttggaattcctctgaaaagaatttttttaaaaatttggttaccctgctttatagtttctatagaaaggtaggacgaatgcctaattcctttggttttatttaagatattaaaaaatgaattggttctccaacattctgcaaaggtaattgttaagtattatggtttgtttttgttttaatttttaaccatgaatcattatgcacttgggggattttctttagaaaagcatttctaatgtgcttcaaactattgcttattggctagtggaggctccttcaagttggctcctattaatagattattttgacatgctgtcagtagtctttctagagcgttatttgaagagtccgacttacgtatacgtccatgaaaccatcaccataatcatgataatgaacgttttcatcacttccaaatttttcttttgctattttataactcattcttctctgcatccccatctgcagagaactgatctgccttctgtcagtatagattagcttgcagtttctagagttttacataaatgaaactatccagtacgttcccctatttttctggtttctttaatacaacctaacagcctagattgttagattcatttgtatcattgtatatatgatgactgagttctttttattgctgagtagcatttcatggtagggctataccaacatttgtttattcgtttacctgttgatagatacctggtttgattgtgttttctgatttacaaatacaatttttttaacatttatttgtgaatctttctgtggacatatgctcccatttttctagggtgtggtatggctgaattggttgtaccattttatatttacactagcagtttttgagcggtccatttgctttaccttggcaccaacacccaatatgttctgtcaatattagccattgtagtgagtatatagttattatacctcagtgcaattttaatttggatttctttaatgactaatgatgttgaacatcctttctgtctctctctctctccttgtctgtctctgtctctgtctctctcaagagaatcttgctttataggccagcttggtctcaaactgttggcctcatgtgatctccccactttggcctcccaaagtgctagattacacagccatgggccatggtgcctggcctcaggtatatttttaggttgagtgcctactcaaatcttttgtccttttttattggtttgtttggcatactatttagtgctaggatttcttttatatgctagatacaagttctttattggctatgtgttgaaaacatttttctctcattaggttacctgtgtttgcatttacttaacattgttttttgaaaaagcaacagttttatattttgataaagtccagtttatgatattttcaagtataacttgtactttttgtgtttcacatccaacctaaggccactaaccctttctcctgtttgtcttttctccctagaaattctgtaatgttagctcttatatttaggtctgttatttggtttcagttaatttttccatgttgtatgaaataagagttgaggtgctttcttttaaatatggatatggaattgttccagcaccatttgttgaaagataatcctttccctttgtcttggaacactgtcgatactcaactgactctatatatgtgggtctatttctgaactctctgttctgttccattgttctgtatatctccctttacactagtttcacacggagttgataagtgttgcttgaaatcataatgtaagtcttctaacttcattcttttttcaaaaaattagttataatattataaattatttacatttctatagattttagaattacttttgcagtttttacaaaaaaatgcctcttttattattgtcatttggattccattgaatttatggatcacttgggggagaattggcatctttacagtattgagttttctcattcatgaacatggtatatctctatttcatttaggtcttccttaaattcaacagtgttttgtagtttttgttaataggtcttgcatatcttttgtcaagtttactcttaactatttcatattttgtcatgttattgtgaatgatattttaagaagttttagtttccaagtgtttgttactattatataaaaataaaatttttttttaatgttaacattgtattctcccaccttcctaaacttactcattatgtgcagttgtttaatagatttataagaatttttttgatagtcatgttgtctgtgaataaagacagttttacttcattctttatgacttttatgcctctagtgatccgcttctgggactataggcacttgccaccatacccagctaacttttgtaattttagtagagatggagtttcaccatgttggccagcctggtctcgaactcctggcttcgggtgatccacctgcgtctgcctcctaaagtgtcaggattaaaggcgtgagccaacatgcctgacctttttctctgattgcttttaatgttgttatgcagctattgaacagcttttagtttacagttcattttccttcactactaagtcagaaggcttttgctgactctgctcaatgccctatgtattaggaaatctttttcctctgactagaaaggaattgttttgcctatttccctggcccctgtagttcctgtacatgtacagtttggtcagtattctagggagcctttctatcattctccagagttcttttaagcttgttcatctttcatactctgccctacaaattttcactgacttagtgttaatgatagctgaactatttttacattgctaaggctgccatgctttcttggggttccccatctatatgttgagatctggaaactctttaggcaccatgttggagaatctgtgagctcatcttgtctgttttcctcctctcagttatcactgttttgcactgccatttgtctaatatctgaacatgtttttcatatgttttgtcacattttaaaattccttaatgtaggagggtaaatccagtccctgtcactttattttggccagaagcaaaagtcttctgccagttgcatttagcatttttgcattggtattcttgagaacggttgcaggcttttaaaaaattttttgtcagatttcagaattattaccatgtttgtttcctaagaaaagtatcagatactttgtttctctgtttttagtagtttatatagtacttgtatgatctagtctttaagggttgagtagaagaagtgttttaggttctctgtttctcctgtgctaattgaacttcttagacttttctgggttcagttttggtaaattgtatttttctacaaaattatccagtttaactgggttttcaaaatcacttacagaagtttgtataatctctttttctcctttttttttaaataaactttctcttttttgatggttatctgttttttgccctttctaatttttcatgtttttttctttatgctttgcttcctgattagtttaactgactacacttaaaaaaaaattagtcatctttattggattttgttctgattatgaaagtaaacatgttcattaaaaaaaggtttagaaaatttgaaaaaagcacaaatagttggataaaaatcagctagtctaccacccagagataaccactgttaacagtttggtaacttctggtatgttggtatgcatataattgcatgttaattttaacacaactgagatcagttttctgtgcacattcttgtattgatttcctggggctgtcataataaaatatcacaacctgggtggtttaaaataacagaaatttattctctggcagttccaaagaccagaaacccgaaatcaaggtgtaggcagtaccatgttctctccagagctataggagagaatcctttcttgctgcttctagcttctgctcattgctagcaatccttggtgatccttggctttggcagcatgactccattctctgtgtccatactgatatctggacacatggccttaatatgtccccccccccgccttttttttttaaggacaacagtcattggattagggtctcaccctgttctcatctgacttcatcttaacttaattatatctacaaagaccctgttttcaaataaagtcacattcacagattcctggcagatgtgaattctgcagggatactagtcaacccaatacagcattctattgttactttcctttctgttaatgtcaaagctttctttgtactttcatttctatcagtgaattttagtgtctgctgctaggcaaaattggtactagagtgtatcagcattgcaatgtgctagcatttagttatacctacagtttgcccataaacacagatttccatcatgacctgacagtgcttcatcatagaaaagcaaatcagaggtcattaaattttcttagagcttatatcctggttaattttagaaaatgagaatgctctttgttacaatgttcttgaaaataatttaattgtattatatctctaagtgaatagaatatgttttcagacccaaattgtgaatcataaagaactgaataattaatctaattggatcagaaaactaagaaaaaaaaaatagtggcatgagtgtttttgtttggtgtggtatataacaagacattcctggtgctcatcctggtccttatataagctagaacatatctggtcatttttctcatttgttgaacaaatgtttaccacctccagttttatttttgttatctcaagagtcagtagctattctctataataatggtgaattaagtattattgtggctgtgtttaatttaacacttagattagtttcagattttcactaatctaaacagaggattgtggagggcagggtttggaagaacacccaaaattctttgaggacattgtgtgttatgcactgcgctatgttgcatatgctatttttctttaactcctgtaatgctatgaaaggtaggcattaaaaccatgttaaatactagaaaaatgaaaacaaaatcatattactagttattggtatagttggaagtagagctcaggccttaatttcctgagatttttgcttgtagcactagttcttttattaatatacgtacctgcaggctccagtgtaaaaaataggaaatatgtatgaacatcttctatgaagttttctatatggcagcccatttaaaaaaattgaagtggaattttgcttattttcttttgtttacatttgtttacattattgtattcatttgtttacattattaatacactgtctcttcgtagtaaattacaggccaataaaagttctttatttgttagaaggtcagagaaagtagattttatgtttttttctaattaaataattttattgggaaaaaagaaacactttgaacatgaaagcataaagactattattcagtcagtttagtaaatcatgtgccatgaacacaatgtgcggggtggccctggcagactgttcacaacctgcaggaagatgtcatgtttttatgctactcatttttttatgttattgctttaaatgacatggagaattttaggtgtttaaaaaactatctgaaaagagttgactaattattgttgtttgaagcaatagtgatatggtgtcttctacctccggcaagcatacaaacaccatttgtctaaatagctctgtgtgatccaagatatactattatttacttagagtttttatggtttacatcagtaaggaacttttatcatagggtgtttgtgaaaaaagaactgcctgatctcaaggaatgctttatgataataatgacaggctgtattagcatgattgtagcctgaagcctcccattcctgaagaaggggccactactatttcttgagccttttccttccactctgacccccatcagtcctctttaccaagtactcatttacattatagttcatagtgtggtgtcagctgttcccaaaggtgctctcctcaagcgagtgaatcatttctaggataatggcttgtttcagaacttacacaatgtcttttttggtcttgggagatcaaatgacaaactatcacaatcaagggctagattatggttttttgataacatgtctcaaactagggttagcagtttcttcacttgaggtatatttctggattgaattctataaactgttccacagtagtaatgtcacgtggctcacatttttgcttttgttactcacatactatacagcaataaactcaaattattatgcattatcagattgtattataaatagcaatccagcatcaataattatctcttttgagtgttttgtcttgaagaaaagtgctaagatccttcttagtaaaatcaagctaacataacttttctgtctcctataattgaaatcaattacttcaaaaataaatatagttctatattatgacctaaaaaatatagttctatattatgaccattgaaaataatgaagtgtggttatatagttgcccagttgggacataacctttacaaggcatcattcataatgaaagagtaggttttgttaggacagatacattaatcttaagtaaacatttaagaatttataaaattattataaatatatttgtataactatatagttatatacttaataattatatatatacacacactaatatgtatatatttaaagtgcctctgttgtcatggagtcacagtgagataatgtaataccctggggagtagtagagaggttcattgttcaccctcttatggtaccttttgattattgcattatgtttagaatttaggttgtacaaaatgttttaaaaagctctgtgtgttattaactgttataggagtgtatttctttagttcatggataatacaagtgcttggttgatttacactttaaaataaaacaatcattttgttgaactagagttattttgtttcacaaggtactcacttgatctggttgtaaagaacaacttctgggagtaccattttcacatggtatttttggtttttttccccttccacatagttagcattacacaattgcaaaactttgatttaatgtctgctgctttattttcactataaataagcttaaatgcttatttatagtattttttttttgacctacattaatggatagttttggccaaggtgacagtcttctgggatgtcctaataatttttagctgagttttacgcaaccatctctcttactttgataggcaaaataattagagtgtattttttgagaatctctgctaagggtgccttaaagattcttctaactccaggcctctatgaatatgatgattttccatttttaaaagatgtggcagtatattcttattggcaaaatgtgtttttgcttgtattcatttagagctctgtctcctgtttttctgatgatcaaatggatttctgaactttacgtcacacctttagtgacagaataaaattaaccaactagatgttatcctaagatgaccaagtatctaggcatgaagtgttctgaaaatcatttcacacatttatcttgtgctatatcgaacgctttggtcattaaacaaatggggtgcttttctatacttcgaaataaatgtaaagtgtgaaaatattttcaaatgtgtttgagttcctttgtattttactttacaaatggatttttattatagagatcagaagatagcagtaaatacagtgtcaaaaatttttgttaaatatttatttttatttattatttttattaaatatttaagaaatacattgtgggccacaccctcagctagaagcttcacagagcagtgccaaccgctttcagtgatgcctcgcacagatatggaggctgcgtagtaaccgcagcagcactacgtagaagaggctttctctgtctagaactcctataggcttaggaaaccactttgcatggctgaagtctcgtgtgtaacctaccaagggggccagtggattccctccaagttcttgcttcttcttggtcctccccagaattctctaaagtaagtggagggtcatgggcctcaaagtatgtaggctgcattgtcacccacagttcctcccacacaagttgctagcggaagagggtgtaggcttctaactctaatcagagtcacctgtggttatgtccatacattcagtctggttggagtcaacttttcatgcctggaagtcattctgctctaatgatagtaaacacttaatgaacacctatactgtttgaggccttttctgagtaatttacagacattagcttgtttcttcttcccacccaccctgtgaggttaaggacttatattattctgaatttaaaggtaaggcaaataactattaagtaatttatttgcttaaggtcaaaaagctagtaaaataccaggttggaattcttatccaccaggctaacttgcttttgatgcgatttaccctgtccatgtgcatagtgaatgacttctctatttccagttccatgaggatttgccctaagagattgttgatgaggagcgttggccccagtgtcctatattcttaagttcaagtcctggttcggctactcttttgctgtgtgaccttgagaaagccttgattcctcttttataaggtagtagtactttctttcatatattcaaaaatgtttattgagggcctactgtgtaccaggcactgtttgaggtgttagggatattgtggtagggataaagttcctgtcttcatggagtttcaattctagtggtggagacagacaggtaaacagcagactagattaaaatgtcagatagtgaacagtgtaatgaggaacaataaagcaggagatgtagagctgttttggacagagaacttttaggggtggccttcgagatagtgatgtttggtctgaaatatgcaggaagtgagggagagagccaggaggatgcctagagaagagggtctcagcgaagcaaaaggccttggggtggaaaagcaaagaagccactatgagcagagtgtttggagggagagcggtaggaaatgagactgggaggcaatcaggaaccagagcagactttgcattttattcatcatgcaatgggagttggcatgagcaggggattggcatgacctgatggagttttcagtcttgtgtggctgctgtagggacgatatcctgtcgtgaagtccgaatggaagaagagagaatgggttgctcccgtgatagtctagatgagacatggtggaaacagcatcctagggtaagcccctcctctggaggcttgtagtccagaacactcttctgccagctgtcctgggcccaatctgatcacattatttaactttaccactcccttccttccctggcatcccaaagcctggttactcttctgtatttctttcctccatagcacttattgctctctaatgtgtggtatcatttgcttatatattaggtttatttatgactttcatcgcttaccagagcttaagctgctcaagggcagggatttttctattttgctctgtaatgtgtcccagatgctttggaacagagcctggcatagagtgtgtgcttggcaggtatttgctgaatgtatggcttaagtgctgatggaggaggtgagaggagatgtaatttgaagacaaagccaacaggattttcttctggatgttcttgtccatttctggaagttattctagtagactggaggtaataaacttaacttggtacctgacataaaatacaacctcaataaaccattaatatatcattataaggccaatgtgcagtaaagggctacattttactctttcatgggaaaataaattaatagaagaaagtatagattagaggtcagcaaactctggcccatgggccaaaatagcccattgcctgcttttgtaaatagagtttaattgcaacagaaccatgctcgtatgtttacatattgtgtatggctacttttgctctatgacaacagagttaggtagttgtaacagagacctatgggtcctcaaaacctgaaatatttactgtctggctctttccaggaaaaatatgccagcccctgatatagagagcattatactgagtatatggtattatatattttgcagtatagatcataatgccatttgacaagttgttataatgaagtaatgttgatgaaagcaaatattgaacaacaggaaagtagttggttatgaattaatatagacttatcttcaccaaatcagtttatttataaaatatcaaaagacagaatctgaaagtcctacaattaatcaagttgaagtatcactgaatattttaggtcatcattcactcccatactcgataatcagaacatgccacaacataagtccagacctcgcgatacttctcggataacagttcttgaatcacagcaccaggccagagtggcaaacagcatcgttttctttggctcagcgatagggttaggctttgtgtcctcacccaaatctcatcttgaattgtaattcctgtaatccgcataatccccatgtgtcacgggagagtccaggtggaggtaaatgaattatgaggatggtttccccaatgttgttctcatgatagtgagtgagttctcacgagatctgatggttttatacagagctctttcccccttcactcagcccttctccttcctgctgccttctgaagaaagtgccttgctttcccttcaccttccaccatgatttaagtttccaagcctccccagccatgctgaattgtgagtcaagtaaacctctttactttataaattacccagtctctggcagttctttatagccatgtgaaaatgtacaaatacactcagtgtgtttaaaatttttctgtgaatcttggataaattaaatacaaacttctcagcctggtgttcacttgcctttctaaccagactctgtcttaataactcctactctctaataagcacacgtacacattctcgttttctctctctctctgtctctctcacatacatatatacgacagttgatgtccgtccctttctgaagagagatgttgtttctttccctacccttggtatccatttgtgaaattccactttcttactcaaggcctgtctaaaatgctgtctcctttttgaaggcttttctggttccagttatggttgttaccttccttgatttggccattcatatggtccttgtcatgtttccttacagttacctgtgcatttgtattattctaccctattagattctaacggatgacatagtgttttgcatagaatgcgtcttcagtaagtatagaatttaattgaattgatacaaatgtttgtgtgtgatgcattttaatatttgctaatctaaataataaaaagtaaaatgctgataactcataatttagaaaactgcctttcctgttttgaaaaaaagagtgcagcttgctgccagtgctcatttaattttacataaacatgctctgtgaggctgaagcaaatctgactgattttcagtgtgaaaataaaacataaaaaatgttcctggagttacttctaaacagaattaacatcagaactgtctgaattatcagaatcgtctatttcagaaaaattggattcatcaaataactcttcggtgaacaattatttgagaacaatgttaccatcatacaaacgaatgctgcgttttctaggatttgacattttcagcgattgagaattactacattttgtaaatggaaataccactactaaaaacagaatgccataaatagaatgatgtcttttgcttccaaagtcgagatactagagtgatgtgaaaataataataaaagcaagatacttcgtggcaaagttatctcggggtgaatgctccagtcacaaccaccactggtggatgttcttggggcaaatgggacaaaggttaaggtatttttatggttggccaggatggactgttattattatgaattttgggattcccttaaagtctactttcaagtggattcaagcatggatagaacaaccaaaggtgttgtgtcttgctaccgctgcttctactcttactactgctttaggctgtctagtctgtagtgcagttaaaaggatatgaagcctcttgaacctctggagaggaccatgttcttttgagccacaggtaatcatataagtagactggcttgacaagtctaaaggccctgaattagttatctattgctgtataactgcgaacgttgctgcttaaaacagcacacatttattatctcacagcatctgtgagtcaatagctcgggcataatttagggtcctctgccaggctgcagtctaggtgtctgcaagaactagagtcttacctgaaggcttgactggggaaggagattcttccaagctcacatggttgttgggagcatttagttctttacaggctattggattatgggcctcagtctcttgttggctgtcaatcagaggccacccttagtttcttgccatgtggcctgctccatagggcagcctacaacatggcagcttcttcaaagccagcaaaagagagagttttctagctagatggatgttataatgttatataatgtaatgatccaagtgacatctgtcacttttaccatacttaactggttagaagcaagttacagatcctgcctacacgtagggggaaaggattccgcaagggcgtaattccaggagtcaggattctggaggccatattccagtctgttgttaagaggctcatataacatttttattagagctatctgtatagaagtgctatgattttcttatttgtattttaaaaattcttgactgttaaaatggcatgtttgtgataattagctaatatatcttgcttctttttcctcttatagcagataagttgtagttaattggtagttcatgttaaagttttatttatatttctgctttttcctaccatttcttctcatgagtaggctggagagagcatgtgccaaatcccgactccttggtattatctgaaatgattgattagttctgccatctttaactcttcccttacattccaggtagctcctcttctggttcttcctttttcctttttctttgttcctttccattcttcccctttggatcattttctatttcactctgcagtttaatgacttttatattccccatatatattttatatgctctataattgtgtgttgaaagtatggtttaaatgacataataattttgaatttgccttagtaacctgaagtttttacagtgggttctgttgagactgcagggttcttaggggttagaagtgagaagataggcagataagctataaatcagttctgctcagttctgctcagaatgtggactgtgctggcttgtgaaagattattacgagtcaaagataagatatagacagaaatagaaggtaagtgtttagaaacttttgtagggtttggtggggttttttgtactttatttgttaagtattaatgataacattatgtcacacactgtgcttttacaacagctctcatgaacttttaaagtatggtttgattcttcctgatagtacttgtggcatcgaagcataccctgaatgacaggctgtatttactgtaaatactttaaaaaattgttgctaacaatatgagtgtaattaatgaattttaaatggtcccagcttattgatattaacccgttgattatttgttgtaacttagtaaattattgccagattctaaatatgggtatgctacttagagaggtccccaagacccctgtagtcttattaaggcatttctttgttgggtttgtatctcctctccattctatttcttattctgtcattttggggggattactttattacattacatatttgggagattagctactttttctttactcacaaatatgacctgaatttggtcccatcagggtttctgctacttgtaattatatcatttccttttcaaacagaaccttgcttaaatagatgtagcaatctttagtccaagtacagcttttctcctttgtaggggaaactggagtttggaggaacagtttaagcagaagccacttttccactctcatgggctcaacctaggtgtcttcacaagagaatggttggcttcactgggttcatgttaatacagggaggaggggagcccacttaaaaatacagtcagtgtcacaaaaatctttttggttttttcctccctaaatatagtatttctttttgtaatagttttatcctctgatttttaaagcatctttttagtttttcttgcttgcttttcttgtgaaagttgctattttcaggtgttttgaattgttttggaagttataaatggaattgtgtacttcagagaaggtcaagtttagaactcatcatgtgtcatgtgcctatctcccttctttatttttaaatggcacacgagtgtctgactcgcacatggtatttcttgctttttagactggtgccagactcagtgtcttttgtttttaatagataaacgtctggtggtttgtgttttgctgcgagatgcatgtgagtcatactaatcacgaactccgtccttcctccaacctctgattatttttggacaatttacctatacctcaacatcttgaagcttatatgttgaaaatctcaactgtatatctgtttataagtattctgattaatcacctgcacttttcatttccttatagatttatgtatttacttttttggtgagcaaactaccagtcttgttggctttgtttttatacttgtatattgttcacaaaattagcaaaagacttaagataattggccattaatctttgtgacttactttcttcatagtcatggacattaccaaaaatcttaatttcattagtatatctaattctgtgaattacactcttctagcacagtggctcatagttaaaaacaaacaaaaccaacaatactatgatcaaaaagacaactgatatattttatgttattattaaagagcttgttcagcattatcaaaatcgtctttatttccccaatatgttatgacaggtggtatgtgtaatggttaagagcatagatgttggagccagaccgtctggattctaccacttaaccagctgtgtgatgtttttgatatttggcaaatcactttacctttccattccttggcttcatctctgtaaaatgaggaatagtagtacctaccacatggggcagttttcagtattagctaaatatatgtaaagtgcttgtaacagtacctggcgctgccctataaatgctatgtatgttcttagctgccattgtttatctttgtgatggtctctatttgtgttacaatttttttaacaatagcaaagaaacctttacttatgagatattaaaagtatgtactaagatttaagttttttaggctaaaaatttctagtaaagctagtttctataactcttaagagatgaacaattgaagctaaacacttttcattatcaagggctattacaaagtgatgttttagacataaaaaaaaaggtctatggagttgcatggaagactaagttatgtggttctgccttttttagcattctggccttctgtgttcgtttaacatttgcaaagttccaaattgaagacataaagataggtgatttgtcaatgaggtagtataaagtcctacatgtcttatatctagaactgaggttttcattgaattaccacttacattttcttaagactgtcgatatacttctatgttattgttttagttttttttttaattgggaacatttccttgaacattcacttagagtatcaaaagaagtttttgtttgtggttggaaaaaatgtctttaacctgccaacagaatttaaaattgcataagaaaatgggtgttgatgctgagaaatggtgtgtaggcagcagatctcttgttctgtctgaaaacagtgatgaaatacaaacaacaaatgtggaattactgttgctctattttagtgtgggaaagataacttcagagtagggagaacaatttctgctgttttaataaacttttattatatttaagcatgggatttagttggcaatcattatagggataaaacaaagctaatttctataaatagtactgtaatgcctgtttcattattattattattattttgagacagagtcttgctctgtcacccaggctggtgtccagtggcacaatctcggctcattgcaacctccacctcctgggatcaatcaattcttgtgcctcagcctcccaagtagcttggattgcagacatgcaccaccgtgactggctaatttttgtatttttagtagatacagggttttgccatgttggccaggctgctctcgaactcctcacctcaagtgatccacctgcctcagcctcccaaagtgctgggattacaaacatgagccactgtgcttggctgtgtttcattatatttatgttgaaatttaataggtatttatagcttgggtttccttgattatctttaggtaattggtgaactgttggaattgtccatagaattatattttcctcttgaaacttttatgatagattagcattaaccagtctgtcgttcttgtggtaaactaaacattacgtaaagttgacctttttaactatttttaagtggatagttaagtggcattaagtacattcgtgttgttgtacaaacatcaccactatccacctccagaacttttccctcttcccaacctaaaactctgtactcattaaacagtaactccccattccctgcagccccaccattctactctctgtctctatgaacttgactaccctaggtacctcatataagtagaatcgtatagtgtttgtcattttgtgactggcttttttcagctcgcataatgttctcaagatttatccattgtgtaacatgtcacatttcattttttaaggctgaataagattccattgtacatatatagtagtttgtttatgcatacatctgttgattgacatttggtttgcttccacattttggctattgagaataatgtttgctgtgatcattactatacaaatatctgtttaagtctctggttttagttcttttgtgaatttcactagaaattgagggatttaaccagagatggctagatcatatggtaatttaatttttattttgttttagtagctgccacactgttttcctcagcagctacacaccattttacattcccactgtctgtggaattttgtgttgtttatatttttcttgagaatcagtcgttagatttcattaaacctcagagtgaactactgttctagtatttagttcctaacagattcatttcgattcctatatactcaatacaacaagtattacagattcgttatattaggcctatttacttgcttcctcatatcacgaaaactttcttgggtagatgcaatgcaaggcattacccttcaccttagtcatatgggttaaacaaaataggtaactccggaattaggcaaaatcttgtgtgcaggaatcttgaaaaactgtattatttttcaagctctccaaaagattgagttgacaaaagaaaaagtagcatcaaatgttttattttaggtccttctgtactgcaagagcagaagtagaccaatgttaataattttgatttctcagattcactgaagagatgtgggtctacaaacactttaggtacttggatcaactattctcaacatgaatatgatactgaattcatttatgcaaatgatttttacagtaggtttgctgttatttacttttattattattattttttgagacggagtctcacttgcagtggcacaatttcagctcactgtaacctccgcctcctgggttcaggctattcttgtgcctcagcctcctgagtagctggattacaggcatgtgccagaacagctggctaacttttgtatttttagtagagacggggtttcaccatgttgcccaggctggtcttgaactcctggcctcaagtaatccacctgcctcggcctcccaaagtgctgggattacaggtgtgagccaccatgcctggcctgttatttactttaacatgggttattttctaccagttacatgatcatagctgagccttttgtgaacctaaactttagaataaccatcaaaacaaaataaatgatagtagacatatgactctcttttccctttcttcaaaccaataaattaactaaattaaaaacagaaatgcaacaatatgttttgccctatatctttatagcactttacaatgattgtatgaagttgagaacagtaacatgagatactattcaagatgattcaccgtactctgtttcctcaggtaaagaatttgtatgatatgtttcagaaagatattttttaataaataaattttagaattacatattttgggaccaaatttaaaaatataatacaaactagtggtaacatctaacatctaaagtaataagaccacagtaaataaagttatctcccccaatagcatgggtaatgttctaccactgcaccctgcaggtcctccttcccttttctctaccccttctcccctcccctgtgcccctacacctctccttccctccttctctcctctcctattaagaattactgctattcacaggactggggcatatctcagtgttgtctttggcaaggaaaagtagttgagaactattggtgtggaagtattaaaccgcatttcagaaaatgtgggttttgcttcttcaaactaattagctgaatcacttggtctgcatttcttacatgtaaaatgaaaaggttgaactagacaaatatatgtttttagatttttttttttccaactttgattttttttttcttatgattcttgagtcttagcaaaacccagaatttggaagcctaacagattgtctgcataatctattttatatagtctctatattacgtccaccctataatattaggttggtgtacaagtaattgcggtttcataccatgaattttaaatcattataactaggctcaaacacacctttattaatcaaaataggaaccattacaatcaatacatttttgccaacgagaagtgtgtttattccagtagcataaaaatctgtgcttcagggtgtgatgaactcttggaaaacattttctgcatcctgctggtggtggaagcaatttcactgcaaacagtcgtcaagatacttaaagaagtggcagttggttggcaagaggtcgggtgaatatggcggaggaggcaaaacttcatagcccaattcattcaacttttgaagcgttggttgtgcgatgtgcggacgagtgttgttgtggagaagaattgggccctttctgctgaccagtgccagctgcaggccttgcagttttcagtgcatctcattgatttgctgagcagacttctcagatgtagtggtttcaccaggattcagaaagctgtagtggatcagaccagcagcagaccaccagacagtgaccatgacctttttttggtgcaagtttggctttgggaagtgctttgcagcttctcctcagtccaaccactgagctgctcctcatcagttgttgtatacaatccactttttatcgcacatcacaatctgatcaagaaatggtttgttgttgttgcatagaataagagaagatgacatttcaaacaatttttttgatttccggtcagctcatgaggcacccacttatcgagctttttcacctttccaatttgcttcaaatgctgaatgaacgtagaatggtcgacgttgagttcttcggcatcttctcatgtagttgtaaaaggatcagcttcaatgattgctctcaatcggtcattgtcaacttctgatcgccggccagtacgcttctcatcttcaaggctctcctctcctttgcaaaacttattgaaccaccgctgcgctgtctgttcattagcagttcctgggccaaatgtgttgttgatgttctgagttgtctccgctgctttaagacccattttgaactcaaataagaagatttctcaaatttactttatgtctaacatcatttccattgtctaagataaacataaacagcaagtaataagtcattagcaaaaaaatataaggtgagaaatgcccattaaaatgatttataacataaccatatttatgtaagaatgtattccaatatcaaatggcaaattccaacaatgcaaaaattggaattcctttttcacttttctaattttaaggcagggactatctatttatcttgtaaatctcaaatgatcaaatgaaaagcattttgcaaagttgacacctagaaagattgcaaattcaaagcaatttgttagcctggttaacatagtgagaccctgtctctaattaaaaaaaaaaaaaaacaaaacacgtgaaaataaattagccaggtttggtggtgcaagcctgtattcccagattcttgggagactgaggcaagaggttagcttgagcccaagagttcgagggagcactgagctgtgatcacgccactgcattccagcctgggtgacagactaagaccctgtctctaaaaaaaggaaattgttcagattaaggaggatataaaattattttggcaaacaccatttacttggttctttgaagttcttattgcctttaataggtacagtttttatttagatgtataaatttcaatggcatatcataaataacttaatgataatgacatataatgacatagttgaaggtaagaagtataccttaatccagtggctttaccacattttcctgtaattttcttggctatatctcctctgacttttagtctgaggattaaatggtcctgagtgcaattttgtctcaatctctaaaagaaaaggtcactattttaaaagcaaagcagtattttccccagaattcccagcacatttcattgatacgaattttatctcaggcacattcctgaatgaatcccagtttccacgaaaatgctacattctgattggcttaggtctgagttcctgatgtatttattggaatacatttattgaagcatttattggagaatgaaaaggtatttccctttgattagccacgctctattctagaactggttccagcgttagttttttgtgagctttactgactgcgtgagagaagagttgattcctgaacaaaatcagtattcttttggaaagagagtggggttaagtcctgagtagcaacatgcactgtagttcgcaccttttgctccctaacattcatacacatccttttcctatacgtgttcttaactaaaacttgctcttaaacaaaccatcctcgccacttccctgaagagggatactcaaagtctcattcaattccaagaccaggatcttagatgatacatagattatatatctgggtggtatatactcctctctgtgggatctagtgtagctctttatggtcttgcaacctgtaactaaaaagtaactcacctatgtctattcataatactggaggaagaacaggatgatgcaatgaaaaaatctcatcgtaaaaggaaaataatagaaaacaacacatattggtcattctttcataatccaggaatggtaaacaccccctgtacttggtaggaagttaatttcttagcatatttgatagcaagtgatttttagctctgagaatctctctcctttccttgttttttaatgccacatctggggttgcttttaggaaggaccattcatttccagtagctctctctcagttaatgcaaggttgggtaggagagatctcaggttgctttggaacagtggttctcggcatggtccggagaccagaagcaatagcatcatttgaacggcaaatttttgggtgtcagcacagacttcctgaatgagaacaggaaatccagcgatctgtgctttgataagaactcccagagcatctgatgcgttctctaagaatcattgacatagacattcagcaggtttttgtggtttctttggaaaatcagctcccttaagtggactaagtggaatatcagtctgtttgttatggtcagttccatttacggtgacaatagccagaaaccttgcctggtcatcctttctgcacctgggaatttttctattatagcgagaagcctctacctaaacttcaggaccttaattgaaaggccaataccatgttttggcctcagcttgtcccttgcctttaggctacatctcagctgcattttcacaatgaactgttttgtctttgttaggcaagaggatgcttagctgtgcttgggaaaggacaactgtgggggtgggagttagatgtcctctgggttccaatctcatctcctatggaatttctaacataccagcttctgttttcacgaacctaagcttggcttctgggatttggccttttgtttggttggtttatttttgttttaaccctattggagtccacattaccagacttttagcatttgggggttataaaggcaaagaggacctctcgtatcaatgctgtattttctcccttctcttctttcagactaagcttatctttatctagactagaaaaaataggcaacacatttcatcattgttaatttttctaccatttaagtttcttttagttgaagcaactatagtataatgtttagagtagtcatgaaatttaaggcattagcttattgtttgagagttctgatgttaccttctcccacatcggagttagaaattggcattatggatgaggacaggaagcaaaatagaaaaggcaagtccattctctcttgtctagcctttctgtctccctctatcaccccatagtgccatagcttcacaggaaacagctagcaaacacaaatccatggagtagtgctaagcaatgtgctattgacacactgtgtagtgttgatgaaaaaagccagacaaaaagagtacgtactctatgattccatttatataaaattattgaaaaccaatttatcctgcatactaatttatagtgaaagaaagaacaataatttcctgggcacttgggtagagggtttagagggagaggtgacagagagacacaaggaaacctttagggacaatggatatgttcattatcatgattgtggcaatgtttcacagatgtattcatatgtcaacacttaccaaattatactttttaaatatgtacagtttattttgtgtcaattttacctcaataaagcgaagattattaaaataattatttattaaagtaatacatactaagcaataaacaaggtacctccttccccacaaaaggagccttttgagtcttcttagaattaggaagaggtaggtgcagacatgaaatctggcagttaattagcctgtgtactggaactcctttgctttgctttgctttgtttgtcttgtcttgtcttgtcttgtcttgtcttgtcttgtcttttgtcttgtcttgtcttgtcttgtctcttttctttttttttgaggtagagtttcattcttgtcagccaggctagagtgcagtggcatgatctcagtttgctgcaacctctgcctcctgaattcaagtgattctcctgcctcatcttctccagtagctgggattacaggcgtgcgccaccaggcccagctaatttttttgtatttttagtagagccagggttttgctgtgttggcccagctgatcttgaactgctgacctcaagtgatccacctgcctcggcctcgcaaagtcctgggattataggcatgagtcactgcgcctggcctggaaccccttttcaacttcagttttcatatctgaaaaatggagcttctactaccggcaccaagaatctgctggttgtgcttatcaaaatgagatgtatatgagggagccctgctttgtgtactttacatgagcaactaccctttctcttctccttccttctcctggctgttgtaaaagggacccatgggtttctgctccctcaagcctcctttttactccctcctatgtagatgaaaaaggaaagcaggagtgtacctcctatgaatagcccacacctgcacttttcgatagtgactcggtagagtaactatttcattcacttggacatgacctcaagatttagcagtgggaaaagaaaagcatcgaagtaaatcaaactgacgattatgttacaaaggctatctgatttgctgagttccagccatcatattaccaaaaatataatgtttgcatattatacaaacattttcatttttaaaaaagcagcaccgtcactaagttagttatatataaaaattcagcgtaagttgcagttattctgtagcatattcagtggcattacagttgaaaagaatagaatctgggaatccaggtctttcttatgattcacttttgtctctgtcataggttggctttttagggttatactccatgaatatcaccacctcttgggatggaagttctcagctggcacattccttgctcatctctgaaatactgttctttaatgttcttatttaagttcttaaattgacgtatttcctctgttgagatgcattttttcccttttccatccaaatgtttctgaaaacagcacaattctttataaaggaatatacattcctttaaatacatcttgtatttaatgggggtagtttttatcattcccttctcctgttccaataaagaaaagagctctcactgaattgatagggattctatccatcagtcaaggaaaagaggtgtaatgtgtatgtaggagaagaggcactaaaccactgtgcagctgaggtccgcgtgggaaaggtttcttctcatggatatttgggtagtcgccttgatagccagtggactgtgtgctaaggccctaccagttccctcattttctctctctggtaaatgctactttgtcctggccctgcgttaggtagtaatctccaagtcaaagatgggcagttgaattttactgaaattattacaatgttgattaaaattgttagctctcgaatttggagaatttgttgaagttaaaatggtgggtaattacataaatgcttaggcactactttttcatttcactttaaaacatgtcatctctcttccttatgtgattgctcacaccattatttgacccaaacaatttaagttttttcccacacaggttagaaatttaagttttatctgaatttagctttctagtttcaatgcccttgaaatataagattttttttttctttcccaggatgttttgactcatgttagaacaataccttttatcccaggcgccaaaatatggtacctgttacatgttatagaattagcctcaaccactgtttcctgtgagatttcacctcagcagacgtcagcctccataaccactgagagaacaaaaacaatagttttgttcactaatactcctttgcttttagagtatattttatggtccattattcaggttttttggttggtatattttgcctgtggcttagtcagattttcagattaacccttaggtaagtctttgctagagaccactttcccataagttgacctttagaatatctgaaagtacagatttagttttgcttagtttaacagcagacgagtgttaactattaatctgcagaaataaatatttctaatactagcataaatttggcttcacttcagcatataataataataataataatactttttataaatatatatatgccttgttttcattcctgcaaattctaattcagtaaatctgataagggggccaggtatgtgtacctaaaaagaaaaaacaaaaacaacctacaaccccaaaaccaaacaaaccagacatagagaacagttaggggtggagctgggaagaaattgtgtgtgtgtgtgtgtgtgtgtgtgtgtgtgtgtgtgtgtgtgtatacttctatgtatatgatttttatatatgtatacatctacttgtatatatgtatacatctacttttatatatgtatacatccatttttatagatgtatacatctactttacataattttaaaacagtatttgttactgctttttaaactttatggtatattaggaatatatcttacatggcagaattatattcttaaaggataaattatatgtctatttatatgtataatgtatacatatattatgtaaataaaatctcctactatggtaggaagtgtatagttgtgttcacagttcctgtttcgttttcagcttggacattcgtaagttagctcaagtctgtagcacagtgtcactttgtctgggtctcagcttgaatggccaaccaggtgtctatgtcacaaacattatttgacaattacagctgtctctactgctgtctttggaaagtatagataatatcttagccttaatttttgtctgctgtcattgctttataaaactaaaaataacaacgaaggtggaacaaaagaaaattttcggaaaagtatgtactttatggttgacggaatttcattatcttttaccatgctattttagtaaacacatttagaaaacagttgttgctattaagggtgtgggactttgtctcccagggagtaagctgctagctacaaatagaacacattgaaaatccaactggagaggcccgggtgcagtggttcacgcctgtaatcccagcactttggaaggctgaggtgggcagatcagctgaggtcaggagatcgagaccatcctggctaacacggtgaaaccccgtctctattaaaaatacaaaaaaattagccaggtgtggtggcgggtgcctgtagtcccagctacttgggaggctgaggcaggagaatggtgtgaacctgggaggcggagcttgcagtgagcccagatcacaccactgcacaccagcctgggagacagagcgagactccatctcaaaaaaaaaaaaaaaattctaactggaatgatcactgctacttattaattatatttattctacatattgtgtgtcaattgacatattagctgattcaaaccaatattcagttaaaagaggccattttcttgctttttttttccccctgtacatctttaattctaaagatcaatatagaaatgtaaggaaaacttaggaagatgttaaagaatcacctacagcaacagtttctgtagaactcgatggatttttttgctggcctgtgataaaatgagaaatataaggaaaatataatgagatttttatgaagctacatttgtgagccttcattatgacattcctcctgttttgttgtttaaaatgtgctattttttgaaaaacagtaatgatagtacaagatagtttaactttttttgtcctatcttggcaaaataacaaatcggtagcctatttgatgtccagttatgtgtgtgtgcattttaagtgtgttgctctgtgacatcccagcatcggaaactactgatagaaactggaaaaatagttactattgaaaatggatggtctttgatagactatcaggccctttatttctcttgttgcatagtctgcttggaatggtgtacagattgtagtgtgtttataccctgtgtagggtcccttgtcttacagctctcgtctccaagctttactttcctgttcccagcttcctgacctctaagacaagattgttgatcctttgtctggcaagatctgcattattgctctgtaccttctcgattcctgacttccatttccctgcttcattgtattttactggatacctttctgcctagcactcctcctagctgtgtagcccagtattggcttgtcaactggtctgtccattatgaaatcaccaagagatttgtgtatttattgttattctaatagtatacaagtcactgtgttaaatgctatagcagatagtaaataaggaagataatacctgttccttaagaatattgagataagcatgcaactaatcatgtattcttacacagaataagtcagtgtttcttaagagaagtacagagtacaattggtgataaaggaaattcaaatgcaattggaaggatctttgacttggctggctgtataactttgagcaagtttcttgatctttttgagcctcagtttcctctacggaagaataataatgcttatatcaagattgctgtgagggtaaatgaaacaattaatgtaaaatgcataactgagtttctggcaagcatttggcagctgtcttttactatcactggccacttctcccctcaaactattttaaagattgtgatgattttttacagggattgagaggtgataagtataattctttcaagtaaagtgaataacaaaaaaaggtacagagttaaaatatgctggaacaacattttggagcaaaggatgtagctgatgggaatagagtaagagcaaatacagctgcaattgtgtttcaatttagtacacatattttaatgcaggggaaactaactccgaaagttcacaattgaagatagagacaggagagacgattgagtcagtcacccaagtggagggatttcattttaggcaagaggagttttgggcacaggaagcttaaagaaggtagggttttggaagtatattcagctaatttttcaactatgtcatttttccattgcttgttgagaattttgatcttgacaaacaggtattatgttatcatttgaagatcttatcagattctgttggtatgagtatctcctgtattcgtttgaaagatcaaaaagtaattttcctggaaaaacagttaaaccaagatgagggctcacagtaggctatatttaacaatgaagtctggcacagcctacattgtgtgaacttttggtttcttgggtttttgttttttcttcacttgatggtgtttcagtttggaagaatgtggctagaccacagtatggcttttccaagatttagttcttgttaagggcttattattttgtaacattggttttttgtttttgtggagacaaggtctcactatgttgctcaggctggtctcgaattcctgagctcaagcaaccctcttgcctcagcctcccaaagtgctaggatcacaggcgtgagccaccatgcctggccattttgtaacatttgaagctttgagaaagatcatactctatcaatttatgaaaaacaaatcatgattaaattatgtgagtggaatggaaagtggaggctgtgagtattaatgcttgagtccaaatggtttttgcatattcaggttatctttgacctgaagcagagaaaaccagaagactgtgtcacattagtcaccttttttcccccattaaaaaaagataccagtatgagtgactttttaagagtataactctgatttttaaattatttcagaacttgtaatatctaaagatgctctttacaaaaaaagaataggtatgttaaaacttttagttttcacttgctttatgtggtttggatattaagttgaccattatgtgtttacaccctttgaagtattttaatttgtgaaaattcattgttatttcatttgtttagtctatgtaatttaaaaatattctaccataggtgtttcttaagacttcagggttgaactgggcgtgatggctcacgcctgtcatcccaaccctttgggaggctgagacaggaggataacttgagggacccagcctgggtaacatagtgagaccctgtctttacaaaaaaaaccttttttacaaaaataaaaataataaaaaataaaactctcctgggttatactgccagattaaatacttaagctctctctgcttttgagggttttagtcattcttggtctctggccatgtaacaacctgtgcaaagattagtaggtattgtgtgctagctttatccttgcatcaggacagtctaggcctatttggattttgcatcttccttgtagttcaacagccatctcattttggttttggctttctgcagtcaaccttcaaagatcttttgttttctgacagttgaagaaactggctcagtgttctttctcctagacaattatttaattgtttacagataactgaaactatcttctaaaggtttctattgtgaatttctttattttataggaagcttcttatgttgaaatgattggtcaacataattcttggtgattagaaaaactgtttttcaaccaaatagcatcaaaatgcttattctttcttttctgattttacactgcatggcttttttctgtgtattataacaaatctcttctttttaaagctaagacaatagcaaattagatgcttgagttggtactgttatagcaagtttaaagaaacgtactcttgtaccctataaatatatacacttactatgtacccacaaaaattaaaaataaacatacaagcagtcaaaaaaatgtgctcttaagaaatttttactttcttaagataatatacagtattattttgataactgtggataggatgaacccgtcttatacaataaagagtttagaacttcaaaactatcatgttggctgggtgtggtggctcacgcctgtaatcccagcactttgggaggccaaggcgggtggatcacctgaggctgggagttcgagaccagcctgaccaacatggagaaaccctgtctctactaaaaatacaaaattagccaggcgtagtggcaggtacctgtagtcccagctactcgggagcctgaggcaggagaatcgcttgaacccgggaggcagaggttgcagtgagccgagatcacgacattgcacttcagtctgggcaacaggaacgaaactccgtctcaaaaacaaacaaacaaaaaatcaaaaaattatcatgtcaacaactataattaaccccaagggaacaatttaacacagagttttttgaattcttcatgtaatattcttagttgcttattttgagcattataaatgtttcagaatatcactttgtttatttaaactttttggtacagtttcatgagtgattttccgtggggaatacatttccatctttattaagtgaaacagtaggaaaatgtgatttggtttccacagttgacttttaagccaacctgtcagcaacacatctgtccataaagttgagtacacctgggacatgataatgcataattatttcctcacagaattgtttaatagtcacattaacctaccagtagccaacacttactgattgcttactagatacagacaccattctgagtattttacatgtatcaattcatttatgttataaattttaaaatatgtttcttttctctttttcttcccctgccctttccccctgctagtgttccttaagacagttacttttcataaacagcccaagtcagaaatattagcacagattgaatatcccttatctgaaatgcttggaaccagcatttcagataagggattttgaattttttttttcttcagtttttgtaatatttgcagatagatagatagatatcctggggatgagatccaactccaaacacaaaattcatttatgtttcatgtgcaccttatacgcatagcttgaaggtaatttacataatattttaaaaataattttgtgcatgaagcaaaattttgactgcattttgattgcaacccatcacatgaggtcaggtgtggaatttttttcttgtagtgtcatgttgttgctcaaaaagtttcagatttgggaggatttcagattttcagattaggaatggtcaaccaatagcttccattaagattgttcacttaatttatggagctttccattggttataggacaaataagggaaagggatcacaagaaatgaggtagtattagaaggagagatgacaggttccctggaagggtactgatttaacttgggtgaatgccagtcatacgtgggaatcacagcttcatgacaaggcctgctgcattgactgggccatggagacactcgaggaaaaaaaaacagagagaaccctggtcttccagtgtaccataaacagctttgagaacctgagctatggaatttaaaatgacgtgtcaagtccgatgaagtgacatgttttcacacagaaccagcaggaggatgaaaaacagaaattgtaaacaaggatgaaagtgacaggtttaggacactggatggacaagaagcctggccttagatttccaaagaataaaagagagaaacacatattttaattaaatagcttcatatttagcttcaagaagatgagtactggccatatatttgaatatatatgctatattagtttaaatctcatgtcagatgatttgcaggtctttttatttgcatgtttatgcagctaagatgtttggcgctcagttcttgtgggagggggcagcttggtatggaaagaacttggagtttgaaatctcactgtcctggatttgaatctcagctgttacatggccttgagcaggctacttatctgattttttgaggtggattcttgtctgtaagatcaagatagggaaacccaactctgaaagggttaaatgagataaggcatataaaatatcagtaacaggctcactggctcacacctgtaatcccagcactttgggaggccgagaggggagggtcgcttgagcccaggagtttgagaccaacctgggcaacatagcgagaccccgtttctattaaaaaaaaaaagaaacagaaaaacaaaaacaaaaaaaagaaaatatcgacaacagtgtctgatgctcagtaagggctaaacaaaattgagttactctaccaaggaaacgacaatagaatggttttccctttccccttgttatagaaagggcagaatatgtaaagagaagacatagaacaactgggagactagaacctctatttgtaagagaagccacaatttgtgtttattttaaaaatgtaaattacttaggaggaaaagagtgttagcagttcaagattatgtggtcggttaaatagttaaacacgttttaaaatgtatgttactttacttaaggatcccatgcgaaaattctcagaaattaagcattgcatatttgactgctgagtacagtgattcatatgtatcttaaagtcacatattcataaaattacacatggatcagattcaattgttaaaagtacaatttttctcaatatgaaattttaaagcatttgtgtactatggtctttttaaagccttgctactcattatagcaatcgaatcactgaagaaatgttcctttttgtttggttcaatgttattgagtcttatctttttgatataggactattttttattttgtaactgtgtcttttattttgtaataaatttgtttaaggtatattttaatattataagagtagaaccaatattttagttttaaaaagacaattctatatcatgtctaaatactattgggaaatatgcctattttttaattttttaaagctagtattgccattctactttttttactttgattaatgtagtctcagagaattattcattgaacatgctttaatattttttcctgatttcaaggagtgaaaaaagattatctaaaaatttctaaggttgtattttcttatgagaatgctatattatctacttatttattcttatatcattagttaaaagttaaatgagtatgtgttatcatttctgaatactatagtgtgtataaggaataccagaactttctagttatgatggccaaagtaatgtcagtagtttatgaaaaagtaatttaggtcttgaatttcttttgattagtcattgtaagcatttttaaactttcttcctcatagatttgtgcacttttagataatgtgtgatttgtacagtcattcttgagtagttgaaacttaaaagaattgcaaatttttgtgcctggtggagataaaataactctgaggcatggtagatacttggtttttgaatctcttgtataaaccaagcaaatgtttctgaaagagcacttttgtgtatgttttgaggtatccccatgttaagtatatgctatctttagaaatttgagtcttatttattgttatcatttgaacaggtgtctcaatgcttgtacctactgcaaaactaaacacgccagaggaaatttggccagttatccaattgatgaactagtagatagagccaaacaatcttttcaaggtaagagtttctagaattatatgtgaaattagtcttcttaataaattatgttagccttctaagtaatacttcagtttagagaccaacttctttagttttctgaagagttttacaaatatacgaacttaattaataaaagatgtgaccagagttaatcacttagtttatttttacattaatgactcttcttttactacgcttctgttttcttatcactctaaggtaaatgacatattttgaactttatcacccacctctagactccatggaaaagacaaaattaagataaaatgaaatccatgagcctctgatgtctgttaagatttttgtggacaagtgaaatactcagatttttcatctctttctttgacatttttggaccatttagaaaatagagctaattagggtttgtagacgtctttgaagaagataagttttcatatcagccaataaaggaggccaccccttttaaccacatgactgtcagaccactaaagattggtactgggggagaggcctaatgagaatgatttgtgtggggtggccaactacttctgagtcatcacttgccgggaaatgtgattatctaggtctctctcagcatatatagtaagacttatctttaacatgagtgacagttgtgtggacatataactgctcaaaccataaacttcctcttttgtctttgtttatagtatgtgcctgtaacagtggtgtgtttttactcccaacatgagataatctattgtctcataatcttgcaggttaatagttattggcaatgtacttttctttttgtcaagtaacttggagtgctagtttcagtatttcatactctgggtctcagaaagtatgagttccaaattcatttttttgtttagtctgtagaaaacttttagaaacatgaatttgtaatgtttctcttaatagagaaaaatatctccttgtttgatttattgatgcctcccaacagtttttctctacttgtatattcttagctcagtcccctcctcctttcacattcaactagtattgagagagaaataaaggacatttactgactcttgctagcattctccttttacagccagattattgtctaatctaagaaaaagcctgggtggttgtctttactacagcataaccaatacttccaaggattttttaaaaggagaaaaaattttcccagaaactaaatctatttgaaaaagtctttgctggcattcttaattagtgtttgtttttccatgtatctgtcagataatgcggatattaaacatagatgatctatctaccaaacactgcaacttagaaggcatgaaattagtactttttttaacatcatgcatttctaagtgcaactgcatataatttttttaaaaatctatttcattttacttgaaaacgtttttgaaaaatgtaaagctgtaaaatcaccatgtagaaagtgaaaatctcctcttcactcgcttacatctattttcacctgtaacttatgctaacatttggatatgattgcttcatggctttatatggacacatttatgaattatatgtgacttgagaaaaaaagaagacagaacagaaatattactggtggatggtgtccaggttctttgcgttttaaacaaagaattggacaaaatgcacaaacaaagcaaggaaagaattaagcaacaaaagcagagatttattgagaatgaaaatacactccacagtgtgggagcaggtctgagcagtggctcaagggcccggatacagaatctcctgagatccaaataccccctagatgtttcccactggccatttggtgttcatcccatgtaaatgaaatggtggtccatggtcagtctgattggttgtagagagcaaccaatcagaggctgaagtgcagttacaaagttcatactcctatgcaaacatccgattggttatggaaagctgaagtgaagttacaaagttacatgcttatgcaaacgtctgactggttgcagaaagcaagcaatcagagatactttcaatttgccatctgccctgcagaaaagatgggggtttgcaaagagagtaacctctggtccttttgttacttgctggaaagttgttttttttttttttccaatttagttctaggaagtcagggtgaattggccttaggttccctgcctccagaccctgttctcctgcctcagaaacatagtttgtataaagtgattatgactttttctaacaatatccaccttagctctgtgatttatctttagaaatgccctctgagtaaccaatttacagcgtattgcttctgtagatctttagtaagttaacattgtcatatccaggtgggttggactagttaaggcgagtgattcaaataatgtatcagaggttagcagtaacgtagctatttttagagaacgtattagaagattactcttattaacatcagtaagatctttttattcccaaccatggaatgtttgcaacatcaggtttttctgttgccttattatctgtgtattagaattgaaactaaatgctagtttttggactggtgagctaatttgtgagataatccagtgtgttcaggaaatgtggttgtttttttctttctttctttcttttttttttttttggtgacagggtctcacactgtatcacccaggctgcagtgtcatggtacagtcagagcttactgcagcttcaaactgttgggctcaagcgatcctcctgcctcagcctccgcagtagtggcgactatagccatgcgctaccaagtctggctaatttttaaattttttagagagaaagagtctccctgtgtttgccaggctggtctcgaactcctggcctcaagccaccttggcctcccaaagtgctgggattacaggtgtgagccactgcacccagccaggaaaattttaagtcctcaagtacttggtgctttttgctataagcagtttggatttgaaatactgctctgttgcttaccagccacatgatgtgaacgtagtatctcacctctccaagcttatggctttctcatcactataatatttaatgtttttattttaagaatttgagataacatgtataaagtaattggctatgtcaatattatgaagaagagaccaggtgccgtggctcacgcctgtaatcccagcactttgggaggccaaggcgggtggatcacaaggtcaggagatcgagaccatcctaactaacacagtaaaaccccgtctctactaaaactacaaaaaattagccgggcgtggtggcgggtgcctatagtctcagctacttgggaggcggaggcaggagaatggcgtgaacccgggaggcggagcttgcagtgagctgagattgcgccactgaactcgagcctgggcgacagagcaagactccgtctcaaaaaaaaaaaaaaaaaaacattatgaagaagaaatattacttaaactaaaatccgaagccaggaagagaagtctaattttgggtaagaatattgtaacatccatagcaaaaacattaatgactaaaatcaaatgatggatttttcttttgagtccaaattatgttttatgaaaaactgctctgtagatagatgtttagtatgacagttacctttcattttctaaatttgagaagtgcaaatttatgctacgggcggccttataatccctttcaaaaataggaagtatcaatctataagctaatatttttaagacattttagtagcattgtcttttttctgcaaaagacattgagattttaatgctgttatagaaatcctaagtttgagctttaaaattgcaaataataattatgaaagtaaccataatagaagaaatgactcattttcttattactatgacttttgcacatttagttatttaataattcaggtgataggaatattctttggaccagaaactcttaagttctgcattctaccatgattagattgcctgtcttataatgaataagaaacatggttttatgaaaagttactctataatgaaaaacctaaatatgccaccaataaattgtagtactaggtttaaagccactctgtggatgggagttaaatttcccatccttaaagcggcattttctttcttttaatttttttaatggctcctgtatgtcagaattaaaaaatgatttttttaaactctatatcaactgtggaatgaggattagaacccaggtttccagtcatatgatagaatatacaataggatcaaaattttattccaaatagcatatttatcagacattttattttattttttatttttttgaggtgagatctcactggagtgcagtggcatgatcttggctcactgcagcctcctcctgggctcaagcaatcctcccacctcagcctcctgagtagctgggactacaggtgtgcactaccacacctggctaatttttctatttttgatagagacagggttttgccatgtttcccaggctggtcttgaactcctggcctcaagtgatctgcccacctttgcctcccaaagtgcagggattacaggtgtgattatgagacattttatattcataaaaatttatttcttgttagtctaatgaatgaggagactaaaggctaacccaaaggcaaggaagcattcagaagagattctgaaataatcatgaagtcattctgaatataaaatggcttcccacaatactaaaaatatgctgactatgcattcagatgtgaaaaaatgagagagctcattaacttttgaatggacagcattaaagtaaatatttctatgtttaaatagaaatgtaatttcttttgtatataaattacatcttactggttttctggcgttttttttttctctctctcaacctccataattgactatctttaccttctcagtgtgtgttttatttttgaggagactgctgcatgtgagtttaagatttaccaggtaatttctgggtatcattttgttgttctcacagactgttgtgaaaccttccttctcacttcctcctttctgatgagattcaggttttaaaaattcctaggattaacagtgtttgggggctgagtttgctgggtttgacacggttgcattttagatatctagaaaaacatgtcaagtggtgaccaggactttgttggggccagaatgaatttacaagctagtgttttctaggatatttgtattgatttttctctagcagctaatcaatcagtttcagttgtataagtgatggagcaaacctttttaagtgtgcagggtgagtggtgtggaaacaacacctttcaccgcactgtctctggaatcaaaatgtagagatgatggatgagctgtttttatagctatcgtgtgcttttctagatctcatttgtgggttactactttttggctccctcataaatctgaaaagcccctgcaagataagtggcataaactggttatggaaaggtaaaataaattaggatgaaatattcagaacagggagaaaatttcttgatgcctagtgatttcgattaatttcgatattaatgttggaattttaaaaaatggattctgtatttcaagacttgcaaagatactatctagtatgtataagattaattatgaaatgcaactgtagtacattgcttccaacttttttagataggaaacaatatgagcaatatttgattttctattgtataagcttaaaagtgttcagttgtacactttatatcaagtcccatttgactgtaatgatgattagtatacactgatttcgacccaagattaaaagggggccataattgtattctgttgatttatatggcagttaaattaaatgtctctttaattcctttatcttttcatatgtgctgtattcaattgagaaatgcatgttatctgtaggattaatgatgcaatttacatgtttgttataacaattgtcaacttccaaaaaggattttaggcagcttacattaaatgattgtatgtaaaagaccatggaaataagaaccatgtaaaatgctgtattgtgttttgaaagagggaagatgattttacaactgttgagtcctggctcttcagaagaatagtgaaatagagtgatttatataatctgataggagtatgtaaaagaaagtatacactgtaccaagagaagtctacatgtttctaggcactgaaccctcagaattattttcatgcattctttcctaagagacactgaatgatatagtagaaatgtttttgactaatgatagaaattgaagatatattttctacctggctttttcttctgttgattcttgcaaaacccaaaaatataatattaaaatgtaacctttaaaagacattttttgggagaactaaataaatgtaatgtacataatacacataactggatcgtgaacacagtgcctaaatagctatttatcagatattcagtttaaataagctaagattaatcgctgtgacttcagggactgttagtttagactatcagtggcagaaacagagtataatttatgtggcctttgcctattcaggtctctgagtttctgtcagtggtgtttaaacttttcttagcaacaaagggtaccctttttacaaaggaaacttgaaaaagtagaggcagaccaccgtggttgaagtagaagtggggccctgtttaatgaggcctttcctcagaactttgaggattcagccagaatctgctggtttagatgagtgtttctgattatttaaggtattcctgaacactgcaatccaggagtggtgaaggtttccttcaaggacaaatagtaaatattttaggctttgtgggccataaggcctctgctgcaactatttagttctgcccttgtagcatgaaagcagccacagaaaatatgcaaataaatggatatggctgtgcttcattaaaactgtatgatagaccagtcgtggtggctcacgcctgtaatcccagcactttgagagggtctcggcaggcagatcacttgagttcaggagttcaagaccaggctgccacacaggatgaaaccccttctctactaaaaatacaaaaattagctaggcgtggtggcgcacgcctgtaaccccagctacttgggaggccgaggtggaagagtcatttgaacccggaaggtgaggttgcagtgagccaagatcgtgccactgcactccagcctgggcaacagaggggatttcgtctcaaaaaacaaaacaaaaaaaaaacaaaaaaaaaaaccctatatgataggggttattgatgaaggggttccatggtcaattctgggggaaattaatttaaacaaattaatcgagattcttcatggcagaacttctggttctgtgtctaatatgttaatacatattgtcaatccataaaagaaggatttaacctttaagaactaatatagatgtaaaatagattaatgttctcaatctggccatttaactcacttgtcagtcttataaaaccaaaactaaatgtgtctgcgtcataaccctaacaattacatcacaatttccatggatgagggctttgcgttttctaaaatacaggtgactgcaatgatagtcagaggcgagaactacaattaagaaccactattctagaaaattttttggttgaagctgtaaaatgagctgaccctctcaattctgtagtgagaaggagtctgaggaaaaaccctggttgattagtaaataatggccatatggggaaggtggaggggcaacacaatcgttgttaatttgctattaccgccctagatagtgaatggatggtttcaaagtccaaaggtacttatttaagttaaaaggctcagctgtttttgttatcaaccaaggcatcacaaaaggatggctgacatttatggagtacttacagtgcatagataggaattacgatgaaaaccacatggtccctgtctttaaagatcccctcctagtttaggagagagagtagcaagttggactaatgaaaattgaagtatgcagaaacagacaccaaatttgggataacagaagtcattcttacaaatcagccaggtttcctcctcagaatccctctcactaagtttttgttagccactgccattgattatgctgagtattcaggatgagatctacttgctgttctgaatcccgaggcttctgttatgccgaagtctctgaaagaaagaaaccaaatggtgactctttaactaaggtaactattggaactatgtagctgttatttttccattcattcaacaaatatttattgagcattcattagaagcagttcttatttctgctaataggcacatgctttagaaaaggtatgataacagtacattatcacaatcaataattgattacttctgccagtaaggaggacagaaagagaggtttgctgataatggggcagacagcttatccttgccatcggaaacaaggatgtgatcccaagtttgttacatttgttcataattctgagttttcatagttcagagtatgtatagtccaacgcacagaaaatctgctgcttctggaaataccttgttaaatctatccttaatgaaaatcatagtgcagtcatccctcactgctattggtgagttttatttacgttttactcttttgtgctctataaaacagtttacaaacatgcagttaagtataaaagttatttaaaataatgaggctctgggaaaacagataagaatagaaagtccaaaacttggtggaaaattggaacacaggaaagttggccataatcacacatgtggtttttaaaatcaagcaacagttttgactcttagcttcttgaacacttattgtctttaaagaaaagtaataccagcttggcattaggtttgaaagagttttcacatagggagtggtgagggatagagtaggtcccagcagcgtccctttaacactcactcacataccatgtttctgaaagttatatattttggcatttcttgttagaacttgcagacatgctgggcgcagtggctcatgcctgtaatccccagcactttgggaggctgaggtgggtggatcacctggggtcaggagttctaaaccagcctcaccaacatggcgaaaacccatctctactaaaaatataaaaaatagccaggcgtggtggtgcatgcctgtaatctcagctacttgggaagctgaggcaggagaatcgcttgaacccaggaggcagaggttgcagggagccaagatagcaccatggcactccagcctgggagacagagcgagactccgtctcaaaaaaaaaaaaaaaaaaaaaaaaaaaaaagaacttgcagacatgtcttgaaaagcataacaccctgaagggatttattgggtgctaagacaatacaaagtatactactcactgataatctggtctacttccagattccacagccattgggggctgtaaaggactcctgttatagaggctaataccttaggggtttgtacaccataggtcattttgtgaggtggtatagctaggtccaggaagacagcattagaatttgtatttatttgtgttttctcattctttaaatttttcttttctttgtgtatgtttcatattgtatatattagtacaatagtacatgagtataattaataagtatacatccatgggaatacttttaaaaatttttttagctgattcagaaagcgatatgtggagaccactgatttaaaggaacaaatagcctgcccattttccactataaacataattctttcagcgagacgtttggtttgaatagggcaacagacttctgtgttctctatcaagatcctgaggtgcccatattctgctttgattgagtgcaaatccacctgcttttgagatcaaataagcaaataatgaagtttatgtcctttggaggaaaactgatgtatttaatgaagattcttgcctgcatctggtgagagccatgcgtctctgctcagaggtggagagaaatgctgcttactcaggagcacgtgtttcccattgcttcatctgtattttaggacatgggaagacttaaccaagaggggattggggtcaggcgtatgtggcagtgtgaatatgggtttagtaggtgcacaataaatgttgaatgagtggttaatctagaattgattatgcctgatgaaattccatgtatgacttggaacccataatgaaaaagtagtatggaaaaaccatactttttaagtgggcaagagatattgcttagtttcagctgctgttccagcacaattgaatgctgtgtcttatgacatgggcttgattttataacaccagatatgtagaggtggtggctttccaagatttacaacagagaaataatttactttgggaaatcatctgatagttaatgggtatctaacgttttaccaaaggggtatgtccacctagttccacacttacagttataagtaatatatatttgctttgatacctttactaaacaaaattctacaaatgattcttgtgaccaggtacaagagttaaccaaatgtttgcgtttaccatttgagctgaggctgatctgtctctgggatgatgttggagaactttaaaggctgcaagttggttttggaaggttgtttaatggaattttaatagccttggaaagatgtgaaagtgatactgctacctggtggtttgtaaacccgacctttgtgagatattttctgggcaaaagtactactttgtgatgccagcagcctttattgattccgcagagtctgcagttttctaacactggctgtcaattcattccagttgaaaaattattaaatttcttctcctgcttgtgtggatattaaactgcagtaaacatacttgcacaatatcaggtaaggcgagcaaaatttcctgcctggaaaaagaaatgtttgttagtgggaccttggctgttctgcagaggttatacgtttctgtatttctttttatttgttgttctcagtcatgctttttatttctcgtggtgagttccaacacatttcttgttatttgtaatataagaaagagaagtttgatttagattgctgacttttaaaaatacgtcctcttagttaatcatttctggtagtgtgaacaagagggaaacctgggtggtaagagtttttaacctgtgacaatataattgggtaagaatgagaaagaattgatgaaacaaggaatgaataaggaatgaatgattctgtgatcatacagtccacatagatctttctgatttgttgacttttagttaaggaagaggaatgatgatgagatagtaatcatttataaaagtagattttaaacacctccatctttgagaataacctctggagctggcagttattgaggtcattggcacttattgaggtatatgtttgaaatgcaaatatctggccacattcccaattcagtagccttgccataggcccaggaatttgcatttttcaaaacaatcatttcaaatgtttgggaggcagatgatacaaagatcacttctagaaatgtttgtctagagaactttcttaattacgtataccaaaacatttgatcaaagtagtaaagaggattggggaagaaatgtaccatttatgtgagctaataaaaatctgggccagttttctctctgtgatagatataggccccagctccattcctcccacaccagacctttcttcagattctttttggggaatttcttttttgagatgaagtctcgctctgtcgcccaggctggagtgcagtggcgcgatcttggctcactgcaacctcttcctcccgggttcaagtgattctcctgcctcagtctctcgagtaactgggattacaggcgcatgccacgaccctggctaatttgtatatttttagtagagatgggtttttaccctgttggccaggctggtctcgaattcctgacctcaagtgatctgcccacctcggcctcccaaagtgctgggattacaggcgtgagctactgtgcccgtcctcttctggggaattttaaaatacagatttccaggctctacctcaaaagattttgatactgagctaggcttacaagcctgggaatgtttatttttaaagctctgtaagtttgggaatcagtagcctagattttttctggaatttagctctttttattctgtattgacttttttttttcctgtttatgtatcaatattttggtacagtttgagatgagcctttcaaagcaaaatatcacactgtatataattagaagaagaaagggaccttgaacttccttatccatgtcttaataaaactgatacgcctgtaatgtgaaaataattcttcattttttatcaacatgaatgaagtaattagcttatttggttttatagatatatagtaatatataaatttgtgtagttttggaagataactttatttccttgagacaaggtatatctttgcttatttctctttatttgagaagaagtgctaaatctgaattgtagtaggaatctgcagttcttccagtatggacagtgcttcattttgatacatttacatgatggagtgttataaaattgcatgtaataatgtttacaaagttgataataactcagaaaatgtcttataatgttgatttttaagaaatgtaatgtatgtaatgtatgatcacaattacttttaaaaggaagtaaaaataaaaattaaaaacagaaaaaaaggagaaattatgccaaaatgttacttttcttggggacaaagagtatattaaacatttttgctagtttaatattttctatatttttcataagtacatatatcactgtagttagactacataaacaaaataaaatttatttttaaagaattgcatattatccattttttagtataggaaattaaatcacatatgtatctttttttaatgagtcactttttgttacttgactaagctataaaaatagaaatttgactatttgaaacatttgataaactaaaatttatagattaactttgaagttcatggattctctttgatcatgtggtagcctaatattctgaaaattttcttttaacaaataaatggtgttcgctgcactccagcctgggtgacaaagtgagatcctgactcagaaaaaataaaaaacttaaaaaaaaaagaaaaaaaatggtgttatgaagatctgcttcaggggaaatctggaagccacctggctttccctcttccatttcctgcctgactctatggtcttaactacaaatctatgaatacgtaaaagaactgcggaataggaggaagcctttgcagttacttcccttgcccttcatttccagctgaggaacatgaagcctacagagaggtgactccccaagctgctgtcacccaatgccagttctgtcaccactacactgtggcttcttcagctctaacagtgatagcattggtaatatctttttggaaagacaattcaaagaatatgggaggaaaaaaatgatggtgagtatgagagtttacagaaagagaagttttggactagaagattaagcagtggcttcttagaagagaaagaacttgagtagggccagaagtgttctgcctttgaagaggaatacggttcaacttttcatcaaagcccatgagatcccatgtgatctggctgcactttccattccagattcatcctgttgcactttctctaacttgctagcatccaactgttgtttcttagttccttgaatatagcaatttccttttccttgagtggtttttcctgtggtctttgcatggctgtctttttcacattaaagtgtccacttaaatatcacctcctcataaggcccttctttgaccacctttttgaagggaacattttttctcttattctctatcatatcactctgtttatttgtttcaaagcatttatcataattctttttttcttttcttttgagatggagtctcgctttgttgcccaggctggagtgcagtggtgtgatctcaactcactgcaaccttcgcctcccgggttcaagctattctcctgcctcagcctactgagtagctgggattacaggtgcctgccaccacgcctggctaattttttgtatttttagtagtgatggggtttcaccatgttggccaggctggtctaaaactcctgacctcaggtgatccgcctgcctcagcctcccaaagtgctgggattacaggcatgagccacttggctcagccaaagcatttatcataatttgtactttgtattcatttatctgtttattcatttatttattgtctgttctgagaagtaagtgagaatacctttgttattcatcattgcattactagagcttggcatagcatagggcatagagtaggcccataataaatacttgctgggctgggcacggtggctcacgcctgtaatcacagccctttgggaggccaagtgggggcagatcacgagatcaagagatcgagaccatcgtggccaacatggtgaaaccccttccctactaaaaatacaaaaattagctgggcgtggtggcacgcacctgtagtcccagctactcaggagactgaggcaggagaattgcttgaacccaggaggtggaggttgcagggagatgagatcgcaccactgcactccagcctggcaacagagcgagactccatctacaaaaaaaaaaaatacttgctgaatgaatacatgaataaaaataatttataaactaatagaatcctatggaatttagatctgtttagaaacattctgcgtagtgtggtctattttttttttttttttttttagagaaagcgtaagcgtaaattatgtaaatggttctctacaacctcatcctattaggagggtaagaactttccctaaatacctttgccagtagtgaagtgacaggcttcagtgatgggggtaggagtagtagccatgtttcatgagtcaggactgatagaggatttgcacatgggcctgtgcacctgatatgtcaaataatcagacctcagaaataacagtggatcccaaagtcccaaaccagaagggtagcccagaatgtcattaaaacaaagagatctgattcagagatcaaggccagagtgtgaaaccataaatgtaagcgtacgtaaacctaagcatgtgaagattaaatgggagaaggtcccgtctgattaactgaatgggttctgttatttgccacttggagtgctggatttgactcagggttcagaggccatgtgtgccatgggcaaagcccacttttggcataaaaattatttaaatatttaattttagttgattttataggttgcattattgcttatatatttcataaatatattttaaaataatcaaatatttaacaaatttggaaaagcaacaattcctgtttccttctctctctataaaaagtggataaacttgaaaaatccttggtagactattacttggtagctcccaggattcatgttctgtgtagacagaacttttccatgacagctggcttgcacatgtgtcttgctttggctagcagtacattagaaagtgtgatgcaggcagaggtttgataagcacttgtgtgctggggcttgttcttgtgggatgttgctggagccctgagccgccattgtcaggagatctgtctaccttattggcaatatcatgtggacagagagatgcttagccagcccacagaaattttagcttcccagctgtgactccagacatgtgaatggagaagtcatattgaatgttccagccaccacattgatcaaatgacctgcccacctgagcctatcccagattgcagaagaattattttaagccagttattttttgtatgatgtgttatgcagccagacatattttgttactttttgacatgtattttaatagtaaaatattataataccgttacatttaactcataagattagttagataaattgaggtatgttttccatgaaactcaatatgtagtaatattaggattatagttttaacaattactggcatatcaccaggaacttttaagtgcagagaaagctaaaaatcacacagccagtggccaagtggcttacagtttacagcctagcatgtaagccgttatatcacggagtaataagagcagcgattcagttaagcttgtgatactatgacattttgattaaaaccagaataggttcaattctgtttccatagtttctagctctgtgaccttaagaaagttacttactcttatccaacctcagttttcccattgtaaaaataaggataaagcatacttactaaatacctgaaaattaaaatagtataatactaagtctgcaatacttggaaaatgcttaataaatgaattcttattattactgttcttaatgatataacaagagagcaaggagaaaggaggaacaggaaaaaataagtcaccacctaagaaatgactgttgacattctttctgccttgtcttctttccaacttgtgtgtgtgtgtgtgtgtgtgtgtgtgcgcgcgtgcatgcgcgcgtgcgcatatacccatatactctcacatagctatgcctgggcttcatttaagaagaaacactgaggccaggcaaagtggctcatgcctgtaatcccagcactttgggaggctgaggtgggtggatcacctgaggccaggagttcgagaccagcctgaccaacatggagaaactccgcctctactaaaaatacaaaaattagctaggtgtggtggtgggtgcctgtaatcccagctacttggaaggctgaggcaggagaatcacttgaacccggaggcagaggttgcagtgagctgagatcgtgccattgcactccagcctgggcaacaagagcaaaactccgtttcaataaaaaaaagaagaggaaacactggactatatgcatatttataaagtgcatacagatcccctgggaattttgttaacatgcaaattttattttggtgggtcttgtatggggcctgagagtctgcatttttaagctcccaggtaatgctgatactgctggtgcatgggtcccactgagtagaaatggactgtaggatgacatgatgcttgtggccctttgtattttggtctcagttctcttcagccatcatctctcctcattctgcaccacataattggttctgcaatcaccacataattttttcttcatacatcatcaatagtgcttactagatttagacaaagtgatttgtttagatgtttatatcctctacctcctcttcagtaaagaccccttgggtcttacttatcttgatatcactattaatgttcaataaatgttttttgaatgaatgtatgcatgcatgcctctatgattctcagaactgtaaaatggaaacttcatcttttgccttactaattggaagcagcgaacattctcagaatgagcactgtaaatgtctggatgctggattttgaaggaatacccaactagcacccataattggtaatgagaaaaatgggttgttcacagatgtgaggtaatttaaggaggataatatggattgggcacagttaagactatatatttttatgaatattaatgtatacccatactgtaatatgtaagcaaataatgccaaactaggtaatatttgaaatgaagggaatcatttatatatgaaatgttgaagaaaactggaattaaaaagaaaatacatttcctttgaaaaatttgattgtttttacatttatatttgttcactctggttacatctgtgcttttcagacttgaaataacttatatgcaatggtctgaccttcattttatagtcatactgacttggagatgtaattcacttatgtaatttgttttagtaaaaaaaggaggagaggttaggagaaacttggcacgatgttaactggagaataaattgaataaagattttaaaataatttcacttaccgtattagcccagcatttgaatgttttcagcaataatgtatctgtaactaaattaattaataagtaatgctgtcacatgaaaaatatccctttccccattaattttgaaaatctgtaatgtttttacttaactgcaactgacttaacttaacttacttaacttaaaatgcaactgacattttgcattttattgtgtttctagacttaaaatggtgacatttaaaatagcttactttgagttaatacaagcaaattattgagtttttttctagcacattagccaaggttagtgtgcctgttaatcctaattgttattactattatttgtttatttaacaaacatttgtcaagtgcctattaagtggagagtttctgatagtgaaatgatgtttacattttacatattctactatgaattctggaacattagaagaagcaatttgtgatttctaactgtgactgatagcaagttatgaaacaaatatatttttctcttcataaaatataaaattgctaaaaaataaagtgctacttaatgatggttggcttgttcagaataaataaagagaaaactaaatggaaacttggaccagtgtattttaggtaaaatggtatttctcaaattgaatatcagctatttcttgacattttatgatgtagtcaaccactctattgctaagtattcttaaacatcgacttcagaaatcaaaattatcattcctaaataagtaaaagtttattgtacatgctgcatgatatttattatatcctaccatcgataaacataaatagcacatggctgattttatctctttatttttattcttttcttatttataatgattgttttctgtgagcacaggtgtgattataaatacaattcaggcattttgccgttttatggtccttatataaataaaattttctaaagtgtgtatcaaataattttccttgcacttttacatctagcttttcatttcatctttatattcacctcatgaattattgctgctggtgcttgttatctctgttttgctgaagcacagagaggttacgcttagagtctgaagaagagtagtaaaattgagatttcctgattgattggcctctgcactttgcactatagcatgctgttcctcagggaaaatgttgggcttaaatacttggtattgcaaatgcatttgttgctataggtgcaatttagtttattatgataactggggtcatttcatcagtttggatcattttgagagaagcccttagtggaattgccatcacaatgctcttgaatggtggccctgacaatatttccccagacctcagtttcgttgtccatagctgttgcaaaaagattaaatacctgttaaatacaacagaatactgaaaatcagagccaagcaaaacttctaggctctaggaaccttaatatactaagagaaaagtgttttaatatttgtattagtaaacaagactacatttaagtgcattcactaagtagttctgtaaggtacatttaaaactaactctgctgaaattgtaaaaaaaaaaatctgttcttatcaaattttgagattgaaaatatttaaaataaaagaaaaatctgcatttcatgttttagaaatgtgcataaaatggatatagtaatgataatgatgcagaaagattggttctgccacatatacttccattaatttgagacttgggatccatgaagatactttaggtctccagcgtacccatcacagtaacttgattgcctaaaatctatgtgcccctcatgccacaggcttgcattaaatgaactgtgaagtttaatttgaaaactatttgcaaaccaattcctataaaaatggatttatagctggaaaccgagtacttcagaagtgctgagtaaatgtagttgtgtgcctgattttaattttaggcaattgtatttgtgatctgctcttgttttgctttactttttgagaaccagtgccccaaagaaagaaaaaataaacctacttttgtttctagtttatttgcaaaccaggtcagacgcccttgattagctctcagttggaggataatttgaaccttgacagattgaacccaaacagcagggtttctctagtctggccaacagatagaaaaaataaagtaaaagctaatgccagttcacaagctgtacaacaggactgaataaatgtgcaactgttaatgaatagctatttcaaatatttacaaaaggcccaagaaaaaagaaaagattagcatcttaggcagctgttctaagggaaacctattagaaataaacatgataaatgatgctcaagagctaatatatctgtcaaatatcaaatacactcagaaaaaaaactgtttcagacacaaaaactattaagacccatttgggcataagagccatcttgctttgtggtttacaccagaaatttattcttatactttttaaaatttatcttttctaactcctcaaatattcacacagatattattttacagattttaaggccaggagttagtggatagaatcattagagttgtgtccatcgtgattaaattggttagaaatttaaaaattcacccatgtgtctttgtatgaagatacaccataacttgttattttacggggttcctgactacataatagtttgactgtgacagtaacaccattttagcatcaggacggttttgctaggaaatgctacataaaaatggaaattattcctgaagcagcgagggattggttcccaatgcagattacaggtacagttactattgcctaaacatgcttggacatgtttctacaaacccatccttgtctttttatataaaatattccttttgcactaagctaaaattaaagcaagctgtatgtgacatttattggtgacttatacagtagacccttaacattcaggaccaagcattctgtttttaactatttcttcataccgtgaaagtctgtggagagaagcaatttgaatttcctgaggcttcaatttgtgtttgaatagcttgtactcttaggctcaaatggaggatcaagtcatttatttgatgagggagcttagccagcatctcggcatttgtatctcagtgtaatatagagtaaatctcttacaattttttagttgtaaattaccagatctttgtttctgtatggaagattgtcaccgaaaggaaagctaattattaatggcatgacctttgtgaatttggagatttatagacaataaggatctactgtgttaatatttgaacagttgtcaaataacggttattttgatttttggtcattttctaacatgtaaaaagtgtgattcacaccagcatgagtcattttgtgaatgttcaaaaaacacgatttatgtttgaagtgtatcgtgttcagtttagatgactgaactgctttatagttgcagcccagacatcactaatctaacagatttcagacgactgtcagattaggtgtgttgtattattagagacacagtatgttttcaggccaatttcagaaccagtggaggagtttggtcattcttagccccttctgacaggataagtgttgtcacagagaccatggtgaaggctgacacagaatcatgggacttcatggtctggtcctaacctgtttctctgattttacatttcattcctctccaaggatgcacttatttcagcagtatctttgttgaataatttcccctatccctaacccaaactagcactatcaaaagcttcataattacctgtcacctggaatcgcctttaatcaccattaattcattgttgctcactaatgtagaggttaggaaatgggaggtaaatggccaaagtacgtattccatatatagtacatctatatggatgtatagagggggcatgaataggtattaagggaatgaggaagaaagctaggcaaatttgtcctttcttttgagctacgtgttacttctgtataataaacaaatcttatattgcggtttaattagttcagagacacacataggcatacactcatgcatgaggagaattataatttgtgcatataaaaagggaaatatcaacactgttgatatttttaatggtgactttcctatttctgccgtgtagaaaaggtactaaatatcacccccattctaaaagtagttttggtgaaatctgaaagggtctgctccttttttagttgatccagactccattgataacactaaattttcatgctgttctgcagttatagacccttaaacttagactctctttgtacttcatcattgtaatttacacactaggttggtacattctcttcaagacagtttgccttgtgcttccagctgctccccaatagccattgtgctgaataagcacttatttcagtatgtccttgatacaattaatgcaggcatctgcagaagcggccgtggcagcagcagctgcagtgccttatggaagccaacttctgcttagcattgtgataaaagaaatagttttgagctggaagctaatgttggcttatttttagcataaaaagagttgcacctgccagggctagcggaggaccgaggtttgttgattacacgttcttgttagtgccattgttattggtaaaatgggcatgatgtcatccttatcaaactgaattggcaccctgcagagtgacaaataatttaccctctgcggttttatcagcatgggccgtgtgttagaagtgactagagtgctgagttttcacagttgaatgctatggaactgcagaggtgtatgaaaatgaaagggattgatacttgtaatcagtgcacatagtaatggccaaggtgtaatgaaacataagtgcacatttagggtaattatgctgctaccaggtggggccctggggctttgcatgtatagaagctgcttgaggtggcggatgtgcagcgaggaatactgcagcaccatctggtagattctcattttctcattaattcttctgtcccctaagtctgggctacattgactttgaacagcacttcatctgttcagtatctcatctcattttagttgggagttgctctcaacagtggtattgatatgatgtaattcacaatctcggccatgtgagatatattaaaacaaatcatctaattgattttctttttaagtaaagctaactgtccctagtaacattcacatgaccatctgattctaaaccatttaccactcttgtagttatttaaattaaaatagagtatttgtttgatttaaattagccaaatgaactttgttcttcagaataatttataaataaaagtataatttaaagagtaaatagtaaaccacattgcattttccttggtcattttttaacgtgtgtgttttatttctacaggccgatgtagtttttgtctcaaatataacaaaaacttgtttattagtgaagcttcagaataagaaagtacagtgatggttgcccagcagtataaacatactaaactccactgaatgcacagttaagaatgggtaaaatggctaaaaacaaaaaaatagtatttgaggttatatattgtgtaaggaagtaaaattcttaaaacttgccaaattaattttatacgaatgctttcacataacattaaaaataagatttctagcataatattagtaggtcatatatggttgatttccttatcaatatgaatattaatatcatgaaacatttttaaagatccatagtatatattcatataacacaaatagtcacaatgaagtagcatctgatggctgattttttaatgctgtataatttataacggggtgcagtgtatcaaaataagacgatctagcatctgtgattgtaggtaactgacattagtgatttcacgatttctttaataagtacaaatataacatttatatggtctgagtgcttgaacacctttctataaataatagaaatgtccccattaaaatgttccacttagagaatccccgtgcattttgtcattttatttccatgaatgttccaaaaatggaaaacgagagaaaaacctattcgcttcttccaaacactacatgaatgctccctgtgatgcccttgaggtcagtgtttgtcagtgtagtgccacaaagatgtggagagctgttctgtcagtgacgctgctgccatctgaatttcccatcactcatttccaacctattgtccagatactgcaggcttcatgagaggatagatttataagctactttagtactttaaaatgcccaactaacttttttccccatttactttgaataaccctactataagaggttaacaaaatgtatcttatttttctcctattatatttctagaaactcattagggcagcaacaagagttggttgaaaactccttttaagttacatcttgggaatttacttgattattacttaatatacactgtgatgatagaaagcataccagcagtactttccttctttcctgacgtttacttgtttgttttcaaagcattaaaatatcagcatttttttcccctcatacattcagtagacatttgctctgtcatctgtttctttacaggctgtgagtataggaagagcctgggtagtgagattacactgttgaatcctggcttggccactagccaggtatatgactttgggcaaataatttaacctttgaaattgtcaattgaaattgaaagtgtcaattgtttcaacatgtaaataataattctttgccttgcataaattgtgagaaatcatcataatgattgagcatgagcactcagtagatggtcaggactgttatggtgcacatttaccaacaaaagatccatagcataaaaatgatcaagaacccataaactcatatttaaattatcttcaaagaaatcattacccaggaaaaatccaagagtaagttgttatatttactaatactgcgcattcctcaagggcaagggtggcctcatacccacacaattccaaggtacttattgcacacaagtaatgctaactgattgagtggcattaaccaattaggagaagtacctgtggatcccttctcatgatgatatttttaaatgtgtaaaataaaattcataggattaaaagaaagcaagttatattgaaatagcgttatcagtacatgaacattttcgtgatatatgtgcttctttatcaataagctgaataagatgcagctgtgtgtctaataattaccataatttcaaagtattgtatatttcaagatacctgaaataattgtaatatgatatgcaaatttttataatttctcatgggtgaaatcacagccactacaaatagctataacttgttgcctacattcacagttgtagaattggtaaattttggcaagaaataaatgaaaacgaagttatgattttttatttttattttttgcacccaagttcggtctcttcccactctcttagtctgttcagtctcaaatagctttcttaatgaagatataaacaacaacaacgacaaaaattaataaaagcgcttagcaacaccaagaaaataatccaaaaatgattaggccagaaggtttgtgctgtcttggcccttgaccaagacctctagttgatagatccttcaaggttacctctctcagcccccttctagaagattaaccatgtcttagaaattggtgctaagtagttccttcttatttgatgatgattttaaatgcatgtactattttgtctgaactagaatccaaactttccatgaaattaacatcattccctgttgaatctaggtgtcatagctctataaccttcaattagtttacaaacaatatatatgtctccttacctgtgaacaaggaatgcttaagaacacaataggcttggaatttgcaactaatttggcccaatcttgagtagatggccaaactaaaatcttgaagttattttgccccaacatagagcaacagaaaagactcaagcaagttccttagagattgtagctgcatagttctagatatctttaatatagaagggagtagccacacaaaaaatatcatgtttaaaaacataaccaacaacttgtattattgaacatattttaatttaaaaatgtatattttagaacagcaatatgaataaatgaaaacgtgtgtgaaaataattcattattactctgaataagcctacttttcctaattatccctaaaaagtttatttttctatttcctgattatctcttttaaaggttaatttattcttatagctttgattatcaaaattatactcagaactaagtaaacaacatcctagcaagggtcatcagtgtgtagagaaagattaatttgggctttcaagatggtacaggattatagaggaggtgaccttaagttgggtttcaaagaacacattgggtttagaagatgatagagttatatggaaaaagacattcccattctagtctggagaaataatatgagcaaatgctgaaagaaatgggcatgcatatttcagtcagagaacactctgcagtctgaatagctgggtggatacaattctggaggggtgaaattattgaagccttgtgtcctattcgttttccttttaatcaaagagaacatattaacaaatctacatggtaggaagataattcagttgtaatataaaggatggtgtgaaaagggaagacattggagacgaaagattattaaggactgttaaaatgttccaggtgggagtcttaaactttggcagtggttattggaaaggatgggttagaaccaaaggatattttagaatacagattttgaaaaactcgagaatttggaaaagaacgcagtcacaaatgaccaaggattgtagcctgagtggttgaaaagggttgtgtcggtaatggaactagagatcaaaaaaggagcagcatgtcttatagggaagggtaattttaatcttgagctcagtgtagtgttgtctttatttgtagacaaatacagctgcccgttccaaattcttatctgtggctccgtttaaaaattcaagttcaaatgaaattttgagagtcaaaaattggagtaaaagctgaagaggggacatgaggggcaagagatgatgaataagacgatgtttaagagatcattgatgtggcagttaggaacttaagagagcatttcaatagattagttgttctcagtctttagtgtgataagaattacctaggaagcttatcaaaaatgtagatttgggaactctttgtcataggtctctaagactagggcaggacctggaagtatgcatttataaactctcaggtgatgcagataataaataatgattatggtagctgatatatattgaggacttcttacatgccagacattgtgattatatttataatcacgatcacataagaaccttactgagtatgtatgtaattttcctattttacaaatgagacacagaatcacaaagaagttaaacaatttcctcaaatttacatagccaggaagcggtagttctgtggcccatgatcttgatcactctgttgttcccaataagtgctgataatcagtatttagaataggggccattagagatacttgcaggagggccattgtcccaccctcacatccaccaaggcccccacacattgtatttatttccgtgggtgttttaaaaggcagtgctttgtttcatgttacaatttttgtaaccttgcttaatttttaatattctttgagccttaagaaatctaagagaccaggtttctcttaacttccaagaggtcctagtgagtgattgcaaaaaaattggattgcagtgcatcgagttgctaaggggaggtgaaagaatcgaagtagctaacatttggaggttaaggagtagtagggcaggtccggaattctgtgtggaaggtgcttaagggtggcagtcccagatgggggagctgtgggtttaaaacaagcagcctgattttacttagaattatgtttgtttgtactggcttgaaggacgttgggcctgggatatagaagtaaataattggggttagaggtagagttagggggagatggctaaagccccataaaagctactctttggtgccctcaaccatggaaacaatggaaatggtatggtagatgatgaaattgtatggaggaaatggcatttttacattgggggctatttatccatgtttctagatgaaaaggaacaaggaaatagcaagtttttttgtttgtttgtttgttttttttttgagatggagtctcgccctgtcgtccaggctggatgatagagtggtgtgatctcagcccattgcaacttccgcctcctgggttcaggcgattctcctgcctcagccttccaagtaggtgtgattacaggtgcccgccaccacgcctggctaatttttttttgtatttttattttatttatttgtttgtttgtttgtttatttttaaactttttttgagatggagtctcactctgtaaccgaggctggagtgcagtggtgtgatcttggctcactgcaacctccgcctccaggttcaagcgattctcttgcggagctgggattacaggcataagccaccacacccagctgattttctgtatttttagtggagatggggtttcaccatgttggtcaggctggtctcgaactccgggcatcaagtgatccgcctaccttggcctcccaaagtgctgggattacagacatgagccaccgtgccaggccacaatattttaatattcctgaaaagaggcatcttaatagatgagagggcgacttcagaagagatgggaaaggaaggtaatgttagacaaacaaaagattagggacattcctactctgatacaagaaggagcaaagagaggttgtgtcaaaaaacttgagatattttgaactgatgggaggagggttaaagagtttcagaataaataatgtctagcaggccggcgcggtggctcacgcctgtaatcccagcactttgggaggccgaggcgggtggatcatgaggtcaggagatcgagaccatcctgtctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagtctagcccttttgataagtaggtggcaagacatgcttccaagtaagcactgagcatttgaagagatggttacatatgacttgatcattctgtatctttgtagacctttgaattgataaaagaaaaaaaatagtgcttcccactcttataaaatgtttcagtatgtacagttataatatttcatgttcaccattgtctctgagatgtggggaggggggttggaagattgattccaggagagggcagcagcgctgtaagcatttaatttgggtatatcctttctctgttcccttggcttttaaaaattaagtaataatgtgttctctgtctctattaccttcactaatgaaaaaaaatagggtctgtaaagctatttaataatcttacaatttattaatttattagtttcacattactaaacatggcaattgtggaaaatacaaagctactgaaaattatcctcatatataatagatctatttgaaacattttggtatgatttagacccagttttgtcctgactctgtgtgtgatttgtataataagaaattgaaaaaaaggcttactagcttaaatagctttaaaaatataaactgtgggaacataggactaattgggcttgttgaaagaatttttaacagataaacattaatttttattaagcacagaccgaattgaaaaaggctaaacttacatgttaaaataatttggcaatctaactgcagattcaaaatttctgaaaatgtaaataaattaaaatgtaggcagtgttttaccatctgtaatgaattagcattccatttttaccagctgctgctggggtttttgaagctgactcaggatctgagcaccctggtgggtttctgctgataaatataagaacctgtagtttaaaactggcagagctggactggggattagaaaagtcactgcaactttaagcagcagattctttcacttggggcaggatgtaagggtgtactttctctaaagatgccgtcagtacaaatgcggaggatagattactactgcttgctgctaacatgacaggacattcagggtgccactactgttgagtgtggagtcagccttggaggaaaaaatccccaaaaccttctttggcaattgtctcttatgtagtggacatattttaggcaaaatgacagcatttgtgcattgatgggattaatgcttcattctaaggattaaattcgttaatattttttctttgtgtacttttttattcctaaaacttttattttgagcatgcaggagacagggatttcttggaaagaatatgaattttgaagtcaggcagacctagatatgaatgcaaattctgttgcttcttagccacttgtaacaggcaggcgtagaattcagtgtgtaatcattaaacattttgttttctttcctcacattggtgaggatagttttcttttgagtatttgctttagtgcctttaattaatgaaaaacaactagttaaaaggttggctaattcctttatgatatacacacacacacgtacacacagagctacctatctcctctcttactttttattgtcagtctttttattacaaattagtcttctacatattataaatttaaatgctaactagaaccagctaaaaagtcaatacacttgttcaatcaacacttttatttaacacatagtatgtgctgtgtattggaaggtctggtgatgatggttccaattctggccttctgaagcttatattctaaatggaggatgctgtagactgctgtgaatacggtggaatcaataagcatttacattgtgatgggaaagacttttgtggttagggaagcattcctgcaggcagtgttgtaaaatgtggagcactttacaaaaaatatgttcataatagcaattacgactgagggatatgaaaacacctcaactgttaaataagcatggtgattctgacctggacagatttgtgaacgtcatctacaagtctttgccatctaatatctgatgagatttagggatttttagcctaatatcttgaaagtatccttggagttttcagatcctcactttgtccaaacttgctgtcctgttcctgttttcacagaaacttcaggtgtcctcacaggctgactaggaccaaggtatacctatctgaccattatgcgggccagtctgaggtcactgccctggggctgagacctgtgtcactgatttactagtgactcactgtgtattaccgcagctggcccttgactctgcttcctcagctgtagttcagtatgaactcagaaaacttgtttgtgacccgaaattagttctgtgttcatttcttactcttactcatgcacacatgactcatgacttagtccttgttttaaacttgtgcattagggtagctctgaattatgtcctccttctcctagaagcagaacctcttatcctgttttgacttggcccttgactgcttaaaatgtctgtagttggctttgtatggttataatcctagccccttaggctgggaattttggccatctgtggtctctatttctagccttagccctaaccaccccacttcctgctgctcctgtcaaatgcacttacttatacttttccgtatgtgtctcaagctttcctacaaagatgatgggtctttgctgaccctatttctttcgttcaggatgagctcaaaattaccacattagttttgaaacttgctctaatttctcctaccaggaggaatttcttccttcttggcaatactgtggtatttaatggtattttactgttttgcactttgtattatacttatttgtgttatgtcttgtcgcccctactagactgtaagatgattttatctgtataccattaagtgtctcatacatacagattctcagtaaaattttgctggtggaatggagtggagacccaggctttagatagtaactgggaacaacaagatcgaatttcttatctgttcgtacctaataagctcctctctcccctcgcccataggctttgcttacctgtcacagaacctaccctgccttttttcctacatgcggtattattgtcctgaactccttcaagtgttaagtaaatcagtaaatctttaaagccaaccttagcggccaggtgcagtggctcacgcctgtaatcccagcactttgaggggcggaggccggcggatcacttgagatcaggagttcaagaccagcctggccaacatggtgaaaccccgtgtctaccaaaaacataaaaaattagccgggtgtggtgatgcatgcctgtaatcccagctattcaggaggctgaggcgcttgaactcggggagtgggcggaggttgcagtgagctgagatcatgccactgcactccagcctgggtgacagagcaagactctgtctcataaataaataaatagctaaccatagcaactctatcagattttaaagaaatatcccccttcggcagggcatggtggctcacgcctgtaatcccagcactttgcgaggccaacgtgggcggatcacctgaggtcaggggttcaagaccagcctggccaacatggtgaaaccctctctatactaaaaatacaaaaattagtcaggcatggtggcgggcgcctgtaatcccagctactcgggaggctgaggcaggagaatcacttgaacctgagaggcagaggttgcagtgagccgagatcgcaccattgcactccagcctgggtgacagagcaagattctatctcattaaaaaaaaaagaaaaaaataataaataaataaaagaagtattccccattggtgattgtaccaaaaggatatagaaatacctgcctagtccctaggactgatgtacaggtggactctttgcatttctgtagagaacccacaaaacctctagtaccagtgacaaagtcaggctgccccaaaggggcaaagccactttggtagagtgaggaagaggcagtaagagtctctagttagttttgaagtcttggtcttccctggtcaggaggagtagagtacacctgctggtttcagcactgctctcagatggttaaaaaaccactctcaatatataatatctcccgcctgttatgtaatagtcacttcaacagtttttatgttgtttaacttttcaatacaacctttttggattatcattatttccacttttatagatgaagaactagagattcaaagattcattcaggaagcaaatatgtgttgtatcctggggtcaggctgactgttgtctctgcctgctagtctggaatttaaaccttgttctcctttgtcacttgatattggcaatttctttcctgtccttgctggatttcctgcatttctcacttgtgctctcctctgacttttctgacctctttggttctaaaaattatccctgattcccacacttctggttcctattctgtgtggtgacccctgctgtttgctgcccacacctcggagtgatgctgagtgagggaatccaatctcccaaacaggaagcttaccaagttttgaaagcagagccttttcttgcagtcaattaaaggttcactctgactgtccatttttaaactatggtatgaattttgtctgtcattttcttgcccttgtcttcctgtgagaagactgtgttttatttatcaagatagtagttttaattctcttagaggttggggctttaataattgagtgatttaaaaactttttatgaacaaattctgtgtcttccatatcacacctagagaagcagtgagggacatattttactctttagaattatataagtaatttcctcatgcatcaatagaaagaaattagctacaggcttcggaatgcttagagtgggaatgcgagataatcgtaagtaagctctacatagctggtattactttttttattccatcaaagaaactacatttttttttgctttttttcgagatggaatctctctctgtttccaggctggagtgcagtggcacaatcttggctcactgaaacctccacctcctgggttcaagctattccccagcctcagcttcctgagtagctgggactacaggcacgcaccaccatgcccagctaatttttgtattttttagtagggacagggtttcaccatgttggccaggagtgtcttgatcttctgacctcatgatccgcccacctcggcctcccaaagtgctgagattacaggcgtgagccaccgcgcctggccaagaaactacattctttaagttattataatatttaaatatataagtaaaatgccaccatatatcataatactgttcttttttgtgatttataaatttctctatggcctgtatcttatactgtatacataaagcctcctgaattcatatataatgtgggtctgagaacatatttgacagttgattatctaaaagtcagataattgacatgttataaaggggtggggagggttgctaaataagtttccattaggctaagaaaagattataaaatttcttattattggttcatgcacagttaagcaactcagcaagtgaaagaaaatttacagatggcttgaatgtgttgggtttttgctttgtttttggcaagggaccatcggctctgaagattagggaagtcatccaggcatcttcctttcccacaaacccaccaactctgttacctggagcttaatacatatgtgatctaatacagtatccttccatgtgattaagcttttctcccattactattcattaaacagactattgacatctctaagtgtgatccccaaaccaacagcattggcatcttggttctcaaacattaaggaacagcacagtcgcttggctggcttattaaaaacaaagattgctggaccccatcctcagagtctgcgattcagtaggtctggagtagagcttgagaatttgcatttctgtcaggttccaagataatatgatgttgctggtctgggactacactccaagaaacactgaaaacagactttgctttcacctttgatttatgaatccctctttgccatatataatcatagcatatattttgtatatgtgatatataaattgataaactttcatttttcattctgaattctgtatgcttgttattgagaactgattgtcatctcactcttctgtgaatggactctttctgttttctaacttgatctcttttacatgggcaagctattgacttggctatatttaactaggcatttgattgacctttcctattaattattaatcttgtagctttttagttgattctttgggctttctaggtaagcaaccatattatttctatttttcctctttgagcgattcctaaaatggctgtctgtgaaatgtctttcatatttgttaacatgttgcttttctttctcttcctttttttattatggttgtgcatctcatgtctatactctttgtttttatgcagtctcaaatctcctgtttgtatctccaaagtagttaataatttttattcatatactttaaaatgcactctttttggaaattgtaaccactgctgcaatcaagatacagaacagttacaccacgtaccaaaattttctccttttccctttctagtcaaactctcttatcgctgcaagtactggcaaccacaaatttcttttcttttcctttggttttgccctttccagatatcatataaatggaatcatgcgatatgtagcctgatgggattcagaacacaccaccccaaaatatggcacattgcatattgaatattttaagctgaaggaatttgagaaatggcaggtacaggaaggactctctgaccttcctctgaagaaggtcataagacatgtcatgtgagaggtgccctccctgcacctggagggggaaggggcattcctgtctccaaaggcggaagaacgctgaggattccaaatgaactccacaggccttgctaagtttcccctggtttgctaactcccttttagctcatacgctttgtcctgtcacattttttcacaacctcccactctttatcaaacctagcataaaaacacccaggttaactgtttccttccatctgcgtttccatatgaagactcccatatcatataacacttctattaaacagatgtgtttacttttctcttttaaatcttttgttagtctaatttacagggcccagccagagaacctgggagggtaagcgaaaagaatatttttttcttcccctacaagctcttttagtctggcttctttcatttagcaatatttttggtttcatccatattgtttcatgttcattcctttttattgctgtgtgctattccattgtatgaatgtaccacagtgtttttaatctgttaatcacttgaagcatcctaggttgcttgcagtttggggcaattatgaataaagccactataaacattcacatacggattcttatgagaacatgtccagtgtcatttctgattttcctactaggtttttcattttcatgtagtctttacttattgtgatatgttcttttctcataatggcttcctctgattcctagagtcagtgtccttttgtgtgttgttaagaacaaggttcaaaactgaaaaattcttttattttttgatttacatttcatactgacaagaattagtctttcttcagcactttggtttttttttctcttttgctcctgaaacttttgtatgctctgagataatttttctttgctcatccgtaagagagaaacctacaggcacttttgaggtatagataaaattaggtactttaagtactgctatgagttctgacagattggtacaggggcccacctataattcttccaagtggaccttcccagatctgtatcaaaggaagtaacaaaactcaactttcagtaggtggctggataggaaatggagcagtggggaattcaagctccatgctggtcaccttctctcatacgttgtcttcccagttgttgcattttagttgacaagtgtaactagttccaggcagatgccccttccccacatatggtaggcaaaacctaaaaatggttcccaatattcttaccctctgctgcacctaccttgtgttgttccctccccctgaatgtgggtggaacctgtggatataatgggctgttcctccagtattgtatagccactcatggctgttgaacatttaaatatgtctagaatgactgcgcaaccgaatgtttcatttatttaattaatttaaaactaaatagccgcatgtggctagtggcagctgtagttaataatgtgcttggtgaagtatttggggtgaagtgtcttgatatatgcatctttctttgaaatgcataagaaagtacaatggatagttgtatggtaaagcaaataaagtacaatattatcatagaatctaggtggtaggtatatggagttcactgtaaaattatttcaactttttctgtatatttaaaatgttttacaataacatgacaggaggaaaccttttgatggactttagtgaaaaaagtaattgcacccagtaaagaaaaatctaggaccagatggcatcactggtgaattctagcaaacatttaaagaattaacaccagtccctctgaaattcatctaaaaaatagaagaggagagaacactttctaactcattctctgaggtcagcataccaaagctagataaagatatcagaagaaaagaaaattatagactgatagcccttatgaatatagatgcaaaaatattaacaaatcaaattcaacagcatattaaaaggattttacacccatcatcaagtgggatttatccaaggaatacaaagatgcttccacataacaaaaatcaatcaatataatatagcacattaatgtaacaaaagcaaaaacagagtgatctcaatgaatgaagaaaaggtatttgccaaaatccaacacttcatctcaggaatgatgaggttgatggaaaaaacaaacaaacaaacaaacaaaaacactaaaaaaaccctataagtagaagagaacattctcaacatgttaaaggacatttctgaaaaactcacgattagcatcatgctcattggtgaaagactaaataaaagctttccccctaagatcaggagcaagacaaggtgcctgctttctccattgctattcaacgttgtactcgaattcccaatcagagcagtgaaacaggaaaaagaactaaaatgcattcaaattggaaaagaagtaaaacagtctctcttcacagataatatgatcctaaatatagaagatcccaaagaatctacaagaaaactactagaactatgaaatgaatgtagcaaagctgtaggttataagatcaccatgcaaaaatcagttgtgtttctcttcatcagcaatgaacaatcataatcaatctgaaaaggaaattaagaaagtgattccgtttacaatagcatctgaaagaataaaatacctaggaataaatttaaccaaggaggtgaaaaatttgtacactaaaaaatatgaaacaagttgtgtgctgtagcacatgcatgtagtcccagctactcaggaggctgaagcaggagaatcacttgagcctgaaagtttgagaccaccctgagcaacatagcaaggccccatctcttaaaaaagaaaaaaaaaagtgataaattatgaaacactactgaaagaaatgaaagaagacctaaataaaagtaaagacattcatgttcagggataggaatacttaatattgttaagatgtcagtactacccaaagtaatctacagattcggcacaatccctagcaaaattccaacagcactccccttttttttgcagttctagaaaagctattcctcaaattcacgtacagttgcaagggccctgagtaaccaaagcagtctttaaatgggacaaaattagaggactcacactccccaatttcagaacctactacagagttatggtaatcaaaccaccatggtacttgcataggaatagacatatagatcaatggaatgggactgaatccagaagtaaacccatacaactgtagccaattgatttttgaccagggaaccacatttattcagtggggaaagatagttcaccaaatggtgctagatttctgcatacaaaagaacaaagttagacccctaccttacaccatgtacaaaaatcaactcaaaattgaaaaacaacttaaatataagagttaaaataccaagactcttagaagaaaacacaggggtaaatctttatgaccttggatttaacagtggattcttagatgtgtcaccaaaagcacaagcaacaaaagaaaaaatagataaatttgacttcatcagactttaaactgtcatgtatcaaaggatattatcaagaaactgaaaagacaatctacagactgggagacgatatttacaaattataaatttgatacaggtttaatttctagaatacgtaaagaactaaaactcagcctgatgcaatgactcacacctgtaatcctagcactttgggaggccgaggtgcatcagatcacttgaggtcagaagttggagaccagcttggccaatatggtgaaaccccatctctattaaaaataaaaaaacaaaaattacccagaaatcgcttgaaccaggagggagaggttgcagtgagccaagatcatgccacgacactccagcctgagaaacagagcaagacgccatccccgtcccccacaaaaaagaactacgactcaacaagcagacaacccagttagaaaatggacaaaagatttgaatagatatttttcaaaagaagataagcacatgaaaagatgctgaaaacattcttagtctttagtgtgatgcaaatcaaaacccttcagacttgctaggatggctttaattaaaaacaaaatagaaactaagtgttggtgaggatgtggagaaattggtcctcatacattgctgtgaatagtagcaatgtaaaatggtgcagctactgtggaaaacaatgtgactgtttcttaaaaagttgaacatagaattaatatatgacccagcaatttctctcctaggtatatgctccaaagaattaaaaacagggactcaacctgatacacatacacaaatgttcattgcagcgatatttgcaatagcccaaaggtggaaacaacccaaatgaccattaacacatgaatggataaacaaaatattggatgtatgcaaaatttaatattattcaatcataaaatggaatgatgttcggatatatgctacagcatgatgaaccctgaaagcattatgctaaatgaaataagccagacacaaaaggacaaatattgtatgatcccatttatgtgaaatatctagggtgggcaaattcatggagacaagaagtagattagaggttaccagggaaagggtgaagggaggaatggggagttattgcttaatggatacagagtttctgtttcaggtgatgaaaaagctttggaaatggtggtgatagttacacaacattgtgaatgtaataaatgtcccagaaatgtaaaacaaaattaaagagctctgttaaaatgaatattcaagacatggactgggagaaaatattcacatttatttggtaaagggttgatatccagcatataaatattttttacagctcaataatgaagacaaacaactgaattttaaactggacaaaagatttgaacagatacttcaaaaaagaagatatgaatgaccaaaatgtacattaaaagtgttcaacaacatgagtcacaagggaaatgcaaatgtgaattacaataagatactcctatacatgaagtacaaccaccagaatttaaaagattaacagcactaaatgttggcaaggttgttgaacaactggaattctcatacattgttgctgggaatgggggtttccacccactttggaaaaatgtctggcagtttcttattgaagtcaacatgcacttatcctgtaatccagcaattctactcatttactaagagaaatttgtcaaaattagtcacaaaaaagcttgtataagcatgtttatagctattttagtcgtaaccaccaaaaattagaaacagcccatgtgtttatctgtagaagaatggacaaaatggaatttatccacaaaatgaactattatttagtgactaaaaggaacgaactaccaatttaagcaataacaggaatttaacaatattatgctgagtaaaagaagcattacacaaaaaaagtgcaagatatgatttcattcacaagaatctctggaaataatctgtggtagaaaaaaaactgaatacttgtaggcacgagggtagggagagattgtctgatgaggtgcataggattactttctagaggaaagtattttatatctttagagtagtttgggctacacagtagatgattgtcagaactcactcgcttaagatctttcctttttttctttttttgtagttgttgttttaagagacagggtctgtttctgtcacacaggccagagtagagtggtatgatcatagctcactgcagccttgaactcctgagctcaagtgatcctcctgcctcagcctcccaaatagccgtggaccaccatgcctggctaatctttaaaaaaaaaattttttttggtggaacataatttctttttttttaaattatactttaagttctagggtacatgtgcacaatgtgcaggtttgttactcatgtatacgtgtgccatgttggtttgctgcacccgttaacttgtcatttacgttaggtatttctcctaatgctgtccctcccgcattcccgcaccccatgacaggccctggtgtgtgatgttcccagccctgtgtccaggtgttctcattgttcaattcccacctatgagtgagaatatgcagtgtttggttttctatccttgcgatagtttgctcagaatgatggtttccagcttcatccatgtccctacaagggacatgaactcatccttttttatggctgcatagtattccatggtgtatatgtgccacatcttcttttttttttttaattttattattattatactttaagttttagggtacatgtgcacaatgtgcaggtttgttacatatgtatacatgtgccatgttggtgtactgaacccattaactcgtcatttagcattaggtatatctcctaatgctatccctcccccctccccccaccccacaacagtccccggtgtgtgttgttccccttcctgtgtccatgtgttctcattgttcaattcccgcctatgagtgagaacatgaggtgtttggttttttgtccttgtgatagtttgctgagaatgatgatttccagtttcatccatgtccctacaaaggacatgaactcatcattttttatggctgcgtagaattccatggtgtatatgtgccaccttttcttaatccagtctgtcgttgttggacgtttgggttggttccaagtctttgctactgtgaatagtgccgcagtaaacatacgtgtgcatgagtctttatagcagtatgatttatagtcctttgggtatatacccagtaatgggatggctgggtcaaatggtatttctagttctagatccctgaggaatcgtcacactgacttgcacaatggttgaactagtttacagtcccaccaacagtgtcaaagtgttcctatttctccacatcctctccagcacctgttgtttcctgactttttaatgatcgccattctaactggtgtgagatggtatctcattgtggttttggtttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatgttgtaggttgcctattcactctgatggtagtttcttctgctgtgcagaagctctttagtttaattaggtcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggccagcaccatttatttaatagggaatcctttccccatttcttatttttgtcaggtttgtcaaagaacagatggttgtagatgtgtggtgttatttctgagtgctctgttctgttccattggtctatatctctgttttggtaccagtaacatgttgttttggttactgtagccttgtagtatagtttgaagtcaggtagtgtgatgcctccagctttgttcttttttgcttaggattgtcttggcaatgcgggctctttttcagttccatatgaactttaaagtagttttttccaattctgtgaagaaagtcattggcagcttgatgggtaaaaaaaattttttttagagatgaggtcttgctgtgttgaccaggctggtctcacacccctgggctctagtgatcctcctgcctcggccccccaaagtgctgagatcacatgcatgagctaccgtgcccgggctacatttccatttatgtagattttccatcaaataaaaacttctagttaatgatatgaaagaaaaaaataatcctgagcttcgaagatgatagtcacacagtgacaaaacacctgtatgtttatgggactgttagcactcgccttgggcagttactgcctgatgttttacaatgtacacaccatgtgtgttaataactagtgctgtaagctacatcttgatgtttcttattgcttaattatcaagttgtagactctaagcaagatgcataagaagtggtgcttatggagttttccttctcaagaacttcctctctagtgataaaatcatcagcacccggattggaacactgtacacattcatgaggagaaaagtgctcagcaatagatgtggaaaaatcagtgagcaataaataattccatgtattttcagaaaagaaaaaacgtttataaaatcacatttttctactgatggctattgtaattttatacaatctgatggaaaataaatgtagtggttatcagaaccttctggtgacattccaggttttctctcttgagctctctactgtttctttgacgttcgtggagtgttggcttaaaatttgttttctacactcttaccctggggagattctgcgtcagcgggtctaagatgctgtcataccattagtctttttaattagtgcatcaggcgatttgcatcaaattgtttgggaaatattgcatttagattataagtaaaggcatcagacaagaagtaattcttactggtgaccaataatagcttaaaattcaatataataataaaaacaatagtaacgtaagataatactattgaatatttatgaagcaattaccatattttagttcctcatctaaatgctttttttccattaacttgtttaatcctcacaaaagatggaggtgctgcaattatctcctttcacagatgagaaaacaggtgaaaggataaataatttgcacctcccctttcccccgctaccctaggcacaaaagtagtagatgacagagtcaggctttaaactctgacattctggcctcagagctcttggcttaaccagtgatttacatggctaccgcatgagttacaggcactatggtgtgttcattttgagggttggaaggagtttttctacaaggcagtaatgaggtgtaatcatggcccagtgtctcagtccttcctcttcttatctcctcaccactctctagcactagtggtcttgaactgagtaagagttggaaggctctggcttgagctctgacgtgatcatttgttagcggcaggaaggtgggcatgctgcagcctgtccttactgtgagttaataacactccccctggagtgcagatcatgggaggtgaaagtacccaacagacgccgggtggcctgtcagtcatccttcgcttcttattccatctcactctttgtcactcatcctgcttatttcttttcttttttctgtatttttttttttttttttgagacggagtctcactctgtcaccaggctggagtgtagtggcgcagtctcggcttgctgcaacctccgcctcccgggttcaagcgattctcctgcctcagcctcccgagtatctgggactacaggcatgcgccaccatgcccggctaatttttgtatttttcatagagacagggtttcaccatgttggccatggtggtcttgatctcttgacctcgtgatccacccgccttggcctcccaaaatgctgggattacaggcgtgagccacggcgcctggcccatcctgcttatttcttacatgcataagggactcttctgcttttctcatggtcatctgtttttcttttttaattttagtcttatctacggagttgtttttttctcaactctactttcaattactgcagcatccttagagttgctgttttttcatgtcttgcctcttctgcacttgtgcaacttgttcttgttgcatatatatctgtattaaaaataagtgtttgcaccgtctcccctgacagagaaatcttaccaaaaagttgaacttaaatttggttaaggtaatgaagaagacatggggacattcccattcttaaaggatgcagtcagcaaaatccagactgtgaaactctttactggaccaaagacacagttcttcaactaagaaagaggtgtggagcagtagggagggagagggagagagactgaagtggggactccttcacagatgaaaagagacttaaaagagaattgaaatatgtggactgtatatggatccttattcaaacaaactatttaaaacttgacaattataagacaagtacaatattgagtgctgatacaatgtaaaaattattttaaaactttttaaggtatggtaataatgaaatatttataggtgaaatgacgtatctgagattttgcctcaaaatccttggtgagagcatgtggctaggtgacccaggggtgatactagttgaagctgactaataaaagcatgaggatgaattataccgtattgtatatttatatatttatatatatgtttgaggtttcctgtcataaaaattacacaaaacatgtactcataacctttctccatctacagaatcatccagatttaacaaagcagttctcactttaaaattgattctaaggagtttttatttacctcatattaactatccacttccagcttggcctggaaagattttgttgcagtattttctgacagcattttcctagataagccaacctttttggaagcagttgccttaagcatctgtcaatagaatctgatcagattggttaaattgaatgaattaaactgaggcaaagtcaagtggatgaaaacctcctggtctttcactaaacatctgctcctagtgacaggttcacaaaggtcacttttactgatttacctgagttgaatttgagggagcaggtgcagagacattggcttcttttgtcctgcacctgccttacctcaggtaagtagaaacagctgttgaaagcagaatagcattaccctgtaggtgggtctggaatgatcccaaaaacgcatctctctgtgccgccttatttttaatagctggtatttttgacttggcatcacaaaagaagcgcattagaacatcttaataatgtactaattctttggggttttgactggagtcagttagataatcatgattcattcaagttgctgcactgaatgcaggttacagcctagtgccatgaggtgttcgctggccttttgcttgcctcaaagcaaaagaacaatagcactcaacatgcttggtcccccactgtataactgaatggttcaatttatatctcatgcctgtagcaactgcttttcaataatcacaataaagagtaagggatatatgtgtagagatatatggctggattattcaggtggggagggcctgactatgggggaaggataatgtgaatttcaaagtgtaaatatgtcattgcataattttttgttctgggcatagttacatttatttatattgtttctaaggctttctatctgatagtatgtagaatatgcagtggttacatacttctgtagtcaaatgaagcaactattctactatttgctaaatctgtgtgccttgagataataaatttagcatctccatcctcaattgcctattctgcaaaatgaggataataacagaactaacttcatagagttgtgataaggataaaaatgaagaaatgtatgcagagagctaagcacagtcttgggcatggagtaagtgcacaagaactcacgatactgatgatgatgatgatgatcatgagtaattgtatagtagtatgtgaacaaaaagattgagttgtttcttactagagcaggaattaacattattttatgttaataatgcagtccttgtcgaagcattcaaatggtgtgattataaatggaattataaatacatagaaaagaaatatgtttcatatttttgacatgtaattgtgtgctgagtacattttaatcaaagacagaatgaaattgctgtcaaggatattggtagttcattagcttattgactgcacactaagtatctaaagtgttattttggtgacagcctgatgcattaatttctaggtcagcatattattgacctcaactatttaattctttaaaaaattaccttaactattttttggtcagatattgttttataaaatcagtatatattcaatgaaaattattttctccttaccataccattcagatggtcttcctaaattaacagtggtaaatttaccagtactagaacttggaagaattaacctcttagcctacaccccacatactttttttttttttttttttgctgtgttttaaacatataatggatatttctttatgtggcctcagggagaaacttattaatacttcaaatttttttacaggttttaagtgtaagctgctctggttttataaaagaagtttgagtgatgcttttctttataaaggctacacttctgaatcagagattttccatttgggaagtttgaagaaggtctttcacttcatgttgagtgttacaggtttaacaactgcccccattatagagataatggttaatttctcctctaagttatacacttctaaactttagttttttacaaaaataacacataaaatacaaaatgtggtggctcacacctgcaatcctcagcactttgggaggccaaggcaggaggatattttgagtccatgggttcaagaccagtgtgggcatcatagtgagaccctgtgttttaaaatatatatacagtaggtaagataactgatactggtgaattttcctcagagaataaacaatcttagttttgtcatgtgctcttcagattctttttgtttttgtttttttaatgaaataatatgttacagataaagttgaagttctctatcacctcctaccaggttctcttcacctgctgctctaccagaagtaactgctgccgtgaatctgttgtgtatcttttttctctatgtgtatgttttgtaagtttataatattaaataatggttttatactctcaaatattttgcagctttgctcttttcactcactgttttcttttatggacctatccatatttgtccatatatctgttttacttattttaatagctctatagtattccatcatgtgaatttacaacttactcacctggtaatggatatttgggttgtttccaattacaaacaatgcaattgtaatgaacatttgcacttatttccttttatacacatgtgagagttacttcaggattccttacctataaatgaaattgtgggttaatgaatatgcttattttccactttggtggatattacctaaatgcactcctgtacttctctcagtagtgtatgtttccatttccccatacgcttgctcagctattcatttttagaattcagaatctaaagtgtctatcagaagaatgaactcaaatgccttacatctttgtaggaaagatggacatgaatacagatgcattcattcagtatgttcttatcatcatcatgttgatgatttccagaggagatttcaagatttgcaagtaacatctaacatcaacagtcgtgagaagtctgccatgtctccatctctttagcatggttaaactgccactgtttataatcattcctggaaagaaagggaatggcttcccaaaacaacccttctgcaagcactaccatacccaaaaacatgtccagttgcgtgattactatggcaatatgcatatttcaatagtcactcctgaaagttttgtccctcaactttctttatccagtggcccttttgataaatatcttatttctctctctccactgcagcctctgatatgccaccacttacatctggtctccaacattattaggaatatgtaaaacaaacatataaaaatagcattctgagcaatgactgaaagggaacactgacagataaaattgaagagattgggattggaaatggcttctttttttcttttttttcttttcttttcttttcttttttttttttttttgagatggagtcttgctctgttgccagactggagtgcagtggcgcgatcttggctcactgcagcctccgcctcccaggttcaagcgattctcctgcctcagcctcccgagtagctgagactacaggctccgccaccacacccagctaatttttgtatttttagtaaagacggggtttcaccgtgttggccaagatggtctcgatctcttgacctcatgatccacccaccttggcttcccagagtgctgggattacaggtgtgagccaccacgcctggcctctttttttcttttgaagtcattttatgcaacttaaaaatggggtaggaagaatagataagaaatcttgaccaaaacaaattcgtaagtccaacagttaaatacattcatttgatataaaatgcatatttctgtaattgcttaaatgagtagtttctagtgccaagtaaaataaagaatacttattttaaatcaataatgaaaaccatggtttgagttttttggcttagaaataaatatatatggccatgtttgatttgtaaactcatcaaattaatgtggttcattcacttttcagttaacattccagtttaggattctgtgtaccactgttggaaactgagactaccagatattaccaagttgggggtggaaggtaggagggatcaccgagatgaaagctccctccctccccactccctacctttctcaaaataaatctgtcttctcaaagagagctgtgaccttggaactctgttatgtacaattcaatcagatgaaagtgttcttgggttcggaggatggtttcagaaattattttctacttggacctgtgccttagtctacttggactgctattacaaaatgccttcgaatgagtataaacagcatggatttactactcacagttctggaggctgggaaatctaagatcatggtgccaacagattcagtatctcatgaaggcacgctcttgccttcaaaaatggtcccttctagctgtttattcacatgacagaaggggtgaacaagctttcttgggcttcttttataaggacactagtcccattcctgagggaatagctgtcatgacctaatcaccacccaaaaggccctttaattaaagttgattcacttgtagacatttgttcagaaatgagtaagtcaaatgggacaccacaagaaaagagactgtatttcctgacccccagtaggaatgaattgggcacgagtggaggtagaaagatgcaggctcagatgaagaagtgattagtatgccaagccccttatagcagaggcctcccaatcctgccgcaagccagagtgagaatgaggccacatgtcctggcctcttttgaccttgggaatctagtgggcagccagatgcctcagataacatacatctgtaatatagaaaaaacaagcatcagggaagtcttcctagaaatagctctaattttgtatcttttttccaccaatcttcagttatatattcagataagtctacttttttagtaagggactacaacattatcctaattatataggaaaaagtcttcgtgtatgtgtagaaaaaagactgaattgagataaaataaagtgattattatctctcagtggtgggattaaattatttaaattttatattctatggaatatttacagcaagtgttcattatctttatttcctacagtgaacatgaattacctttcttttcctaagtataaaataattaaaagtacatttatttcattattaattagaaatacatttttaaagtaattaaaatacaataaaaatctatttaagattggattatatgaatgactcagtcaaaggtctgatgaattgataaaggtaaaatttccaattctttggagaaaaccatgaaaatgttgctgccctttagggtacagtcttgttaatcaacagatctttactcatttacttctaggtgtggaaggatggcccagctcctcttgggtgtataattagtttgtgacagctgccttctgtaatgtgggacttcttgggctctttttactgtttttactgaattttgtttcatttgcttccttttacctccctgtctcttgttggtttgtatatgtgtgttcctgttctgcttgtctttatccctctagatactctcctggtccttagttatttagtaaatttcattctgtctgctcattcacgtccctcacctccaaccatgcctcctatgacattgggaattctcgttcttgattgtgtagccgtctccggttgggatactctgaatgagatgtgtaggcatgctagatcatgactggagcagcttctctaaatgtgactgccattgcgacagtggcctcctgcttaggctttccctgggttcttgtcaagaatgagctcgtttttataaggggtattataattctgacgtggccttactcttgactattgatggtaactatttttcttggcatctgaaatcaaagagatggaaacccggtccctccttctaaattctatggattcagtaggattaggaatgcttactgagagtactgataaaccaaacattacttatgtctcatcatgaaaattattgagtaaaataatgttttgtgaagtcaatcatatataaacttttttatttttacatataaaattccctatttaaaataattttatgattaaagcttttataaaataattttcacctaatttgtgttgctcaaaggagcttctgctaagattcaagggctcccagggttttccctgtacagaatattagttctaagaggtatcttgaggatcaccttactaaataccacattttatttgtatagaaatggagagtcagggggctgcgtgacttgctcatgttatatgactaactctagtgaacacaggccaatcaagacacagtttcctaggatcctttttcttctaattcttttttttttttttttttttttgatggagtcttgctctgtcgcccaggctggagtgcagtggcacaatctctgctcactgcaagctctgccttctgggttcaagtgagtctcctgcctcagcctccccagtagctgggactacaggtgcccgccaccacacctggataatttttgtatttttagtagagacggggtttcaccatgttggccaggatggtctcaatctcttgacctcgtgatccacctgcctcggcctcccaaagtgctgagattacaggcttgagccactgcgcccggccctctaattctttagccaccacgccacagtacgtcttgttaatgaggtgttattttcagggcataatttgtcttgttcttgctgcagtggatcttgtgaacagaatgatgctgctttttaaaaccacttactggtaaaataatatttacctggtacaatgctaagcaatttctatgtcattaattttgtttttattctctggttgggtgtggtggctcacgcctgtaatcccataactttgggagcccgaggcaggcagatcaccgaggtaaggagttcgagaccagcctggccaacatggtgaaaaaccatttctactgaaaaatacaaaattagctgggcatggtggcccatgcctataatcccagctacttgggagactgaggcaggagaatcacttgaacccaggaggcagaggttgcagtgagtcaagatcatgccactgtactccaacctgggcgacagagcgaaactccgtctcaaaaaaacatttaaaaaatttttattctcataactctgtgaagttgctactattatcctcattttactgatgaggaaactaaggcaaagaggatctaagcgatctgaccaaggtgacataaatgtttacttttatgaccatgctgtgtctgcttcaagcattgataaaatgctcaatgattagagatgctagcaccctctgttcttactattgtagggaaccattacaattctgcttcaccttctcagtattctagtcttcaactttttacccgtaataacttttattgagagagtttaaaattaaatagcctgtctcctttcgatttatactatatagaatttggcacatagatgctaccttagacattgtgtgtttggctcaatccttattaaaaaaaagggggcaaaaaacataaaattattctaaagctaatttctgaggccaatctgtaaagtgatggagtgaaaaccattttttgatggctcctaccatttaaaagatagtcttccaactgctgtagtgaaatatgtcagtgctaatgattctgctgctttagtaagctgtgagaagcacaaggcttctctcctgatcagtactgtcacatggccgtgttctgatgcagtatgcaaataacagcaccagcatcgtaagtagatattgctagtggcacatcatatatgggctacttgagagaaaaaggctgctgttaaacttaatgatgaggctgagtgtcattaactgtgtgcttattcaaagagtttccccctgaaacatctgttcccctgtcagatatgtcacttttaagcaacacctgtgcagtagtcatttccaagtttcttttcatgcaatcaccttgttttttgctaatggacttcttggtaaaggaggaaaatgcaaactttctttttcaacatcttactgtagtatccctgcctaagtaatgtgctgtagaagttaaaaaaatgaataacatttcttaagggaatgttttataaacacatggtagaatattttatcattggtgtaaatttgtgtcctgagagttaaatactaaaatgaaaaatcattatcctttagttattgcataatttgtaatagtttcagtagcagtcatatactgaaaatcaatgagacgtgtcgtctttcatattcatgacaaggtaatgtccattggagctcatgtattattatatgaacattggagttttctttgaagtctagcgatgattgtctcactggtgcttgctctgtgtgggtgagagagagagaggccaggagaggacaggagaacgggcatgtgtccgagagacagataaacatattaagtagccctttcggtgatgtacatatatgaagatagtatttctgcgactgttgcctccatttgcagagtctgtttttttcctcttggatttttatttaatatttttattcaactataacatatatacaagaaaatgaacaaatcttcagtgtatagtttagtgatattttacaaattggacataactatgtcaccagcactcagattaagaaacagctttagaggccaggcgctgtggctcacacctgtaatcccagcactttgggaggccgaggcgggcagatcacaaggtcaggagatcaagaccatcctggctaacatggtgaaaccctgtctctactaaaaatacaaaaaaaaaataattagccgggcatggtggcgggtgcctgtagtcccagctactcgggagactgaggcaggagaatggtgtgaacctgggaggcagagcttgcagtgagccgagattgcgccactgcactccagcctgggcaagagtgcgagactccatctggaaaaaaaaaaaaaaaaaaaaaagaaaagaaacacagtttttccagcaactcagaaactgggttcttctcttttctttcctagttgttttttgtttgttcgtttgtttttttctgagacagagtctctctctgtcatccaggctggagtaccatggcgcaatctcagctcactgcaacctctgcctcccgggctcaagcaattttcatgcctcagcctcctaagtagctgggaccacaggtgcatgccatcatgcccagctaattttgtatttttagtagagatggggtttcgccatgttggccaggatgatctcaaactcctggtctcaagtgatctgcctgcctcggccagaaactagtttcttatctttcagctgtccgtctacagtaaccactgtccccctgacttctaacactgtggattattactgtctttgtaaatgaccaagttggaaatgttgaactttatctcaagaacctttatttcaaggttttagcagtgaaatgacatcatctgatttgcatttccaaaggatcagtagctgctgtgtggagaataaattgtaggggttcagaatgtaagtggagggaccagagaagaggctacttaaagaaatcacgtggtggattcacacacacacacacacacacacacacacacacacacacacacacacaatgtgtttattgggcctttaataaactgagtttagctatgaggtatgagtaagagagggagacattaatagttcccaggtttatggataaggtacaatgtactgaacatggaagactggaagaggcaactatttgagcaagaagttctggagttccagtttgaacatgttattttgaaatgcctgtgagatatcaaaggggaattcccaagcaggcagttgaatatatggctatatctggagtttgaaaaaggaatctggaatgcagatataaaattgaccattatctacatatagattatatataaaaccataatattggggaaattgcttaaggacagagtgtagagtaaaaacaaatgacaatatggatatggcatacaaaaagggagagatagaaaagcgggagctttccaaaaggcaataacagaagaatggttattggtaaggggggtgacggcaggtcatttgggtggtctaaatgggtgatggttgaagagtgcattgggacagaacccatccaggagagcagccgtatgcttagttgtgatcctagagcttttcccataagtagtaagtcatttttctgtcttctacttgggctgtcactgtattctatagactgaatgacattcattgtaacaggaagttgccagttttttgagggaagatgtgcaagtttgaatatgtgacttcagggtggaaaaatcaaattgtttttagcatatctgcttgccaggcctattcaccaaaaattgatgccaaatgtctacatttgaacagccaaactaaaaacacctctcttctcactctctctgtcactcctgctctctctaacacacaaacgcagacacacacgaacaactttaatggtgaatatcttaatttctgtttcaaagcttttctgaggatgttagtctttgaaatactctctcctttaatcttcccaagcatcattatttggagatgtgttcttgaataaagtgctgctggaattggtaagcacatgttcattactttactcagccttagttcctttgagactttataattgaatattagtaatacatatcattttagaagtgttcagcgatctcgatgttcccttttttagctttgctgctttcacagtgctccttatatatttaccgaagaaggtgagatgattttctgctcctatatgctttagtttgatttctcaatcatgattgcattttctatatacttgaacacagtgcctgaggagaaaattctggtaacaaagatgctgcttctaaatagaaaatgagttttattcagaagtgcttataaccctccctctggaacaaatgaaactgaagcccatgtgcatttgtatcacggagcagagttgggcttgctttgttttttcataataaacataagtccttctgggattagaaattatagtctgaaaagtgactatgcagaagaggattctgggaagatggcagagtagaaagcaccaggaatctgtctccccaactagacaacaaatgcactgacagaacctgtttgatgtaactgttttggaactctgaatctactaaaggtgtacaatttccagtggaaggctaggatggtgaattgtggttatgtttggtccttagcatggtagcagctacacacccctatccctcagccttggggtaggcagccatacacttggtctaagagaagcttgcaggcagcttgcacaatgtagggtgcacaataaggatccagatattggagatgtgggtgctgattgctgcttttgatcaagagctgcaaacaaagtggtgggcaaccattgtttttgtgccctccctgcattgttgcaagcccctcctcctttaactgatgtgagtttcagggaatttaaaggtctagtccagggctgggcatggtggctcatacctataaccccaacactttgggaggccaaggtgggaggattgcttgagctcagaacttcaagaccagcttgggcaacatagcgagaccccatctcataaagaaaaaaaagattcagtccctttttcaccccttcatttttttctatttccattttgggagccagatcctggaaactagggcattccaaagcaactggacacgtatgaggaaagttagaaagtcactacatgtgggtctggcacggtggctcatacctgtaatcccagcactttgggaggctgaagcaggtggattacctgaggtcaggagtttgagaccagcctgaccaacatggagaaaccccatctctactaaaaatacaaaattagacaggtgtggtggcacatgcctgtaatcccagctactcgggaggctgaggcaggaggattgcttgaacccaggaggcggaggttgcggcgagccgagattgcggcattgcactccagcctgggcaacaagagcaaaactccatctcaagaaaaaaaaaaagaaaaaagaaagtcactacatgtggccaggaagacgcacagactcagaaaagatgtgagaggaccttaagtttacacctcaggcagattattgacttagagactgcctatatcaatcaaatcaaatcaaaacaaaacaaaaccaaaagccgcagcaaacccttgggaaggaagaaaatttcatttccagaatcaccgcattattagattcaaatgtccagttttcagccaaaaatcacaagggatacaaagaaacaagaaaatgtgtcccactgaaaggaaaaaataaaaccaacagactgttcctgataaaaatctgatggcctatattttagacaaagactttaagataactgtcgtaaagatgttcatgaactaaaggaagacatgaggaagtcaagaaaacaatgtataaacaaactagaaatattaagaaagagatagacaacctatcaagaagccgaaaataaattttaaagctgaaaaataccgtaactgaaataagaaattcactagagagattcaaagacaattgtgagcaggcagaagaaagaatttgaatttgaaaataggacaatcaaaattatcaagtctgaggaacagaaaaaagaatgaggaaacatgaatggagtataagggacctgtggaaccttacaccatgaaacagatcaacatgtgcattgtggaaattccagaagagagaaaggggcaatgagaatatttgaagagataatggtggaaaacttcccacatttgatgaaagacatgaatgtaaacatcccagaagcccaacgaactctgagtaggatgaactcagagacccacatcgagacacattatcatcaaactgtcgaaacaaaaaaggagtatcttgaaaacggcaagagagaagcaactcttcacatgcaaaggaaccacaatgagattctccacagatctctcctcagaaaccttggagcccagaagccagtgggccaacataaaagaaaaaagaaaaaaacaaaacaacacaaaacaaacccagacagccaaagaacctatatctaacgaaactgttcttcatgagtgagatagaaaataagacattctcggtaaacaaaagctgagggagtttgttaccaccagacttaccctgtaagaaataccaaagagagtcctgcagattggcgtgaaaggacactggacaataacctgaaaccctttgaagaaatacacatctcagtaaagataaaggcatgggaaattattaaagctagtagtatcgtaacaacagattgtaactccactttttgttttctacatgattttagagagtaacgactaacattttttaaaaaggcgattgttagtctaaaagctagtattattataactttggtttgtaactccctgttttgttttctatataatttaagagactaatgcatttaagttttttttttttaatttatgttttcggacacacaacatataaaggtataattttgtaacataagcagttgaaaggagtgaggacagagatttaaaggagcagagtttttgtatgttattagagttaagctgatataaatccaaattagagtgctataagttcaggatattaaatataatttccaatgcaaccacaaagaaaatacatataaaatacacagatgttcctcaacttatgatggggctacttcccaataaacccattgtaagttgaaaatatctacgctgaaaatgcatttaataccctgttaaacccattataaagtcaaaaagttgtaagttgaaccattgtccatacactcctcaacttatgatggggtcatgtccaaataaacccaccatgaagttaaaaattataagttggacattaaaagtcagggaccatttgtatacaaaaggaaatgagaaaggaatttaaacattgtttcaccacaaaaaaaacatctaaacacaaaagaaggcagtaatatggaaaatgagggacaaaacaaataacaaagtggaagaagtaagtcccttcttatcagtcagagtctgacatatactagaacacagaaggaaattctaacaaatgctacaccataaatgaaccttgaggatgttaatattaagagaaaagagccagtcacaaaaagacggattataacagatatataacacattatgcaattataactcatatgaaattatacatacacattataacacatacatgagtacttaaagtagtcaaaatcatagaaacagaaaggaaaatagtgattctcagggattgagagtagacggaattggggagttattgtgtaatgggtatagagttgcaatttggcaagatgaaaaagttctgaagattgatggttggtgatggttgcacaacaatatgaatcattcaatatgtcttaactgtatacttaaaaaatgtttaagatgaccagcctgggcaacatggcgaaaccacgtctctataaaaatataaaatttggccaggcatgatggcatgtgcttgtagtcccagctacttgggagactgaggcaggagaatcgcttgagcccaggaggtagaggctgcagtgagccgagattgtgccactgcactccagtttggatgacagagaccttgtctcaaaacaaaaacaaaattagttaagatgatacattttatgttatatggaacataacgttaaaaaattgaaaaaaatgactatgaagaaaaaaatagtaataaaaacttacaaaagacaaaataaaaaatactcctaggtagtcctccaacaattgtggactaggaggtacgtgtagcagttaagggttaatcaagggaagccaaaccactgtgagccatgggactaagggtttattacaggaatgagagctcccccgtgtgtgaggagctgagtggcggcgggagggccaatggggagttggggcatcagaggagtcagcagccagggagtcagaagctgagcacagcccaccacccgaggtggatgggaatgggaaggtcctggagggccttggggagcatgcctctgtgtggcagctgcttctgtgggtttgctgccaagcacttcttgtgggcaccatgccactgttggtcaatagggtccactggggcagaagagctggacacagaatggagaagagtaaggatgagctgggaacgctgacatccacggctctgtcaccacttctccccataatgaccttcattcagagagcactggctgcagcttcacttttgctccaaaacttgtgcagatttcttctagggccagtattaacccagaaccttaccagcgaagggccttctgggaactccagcataaccatgggcacagaacaaactaccgcaatgtggaatctaaataaatcatataggcttctgaaagttgatttttttttctctaccacttcaaataccagaattattgaatggagacaaaagaaaggttaatgtatttttcactagaaggtaaatgacagtcttgaatatgcagatcaccataataagaattgaattctgtctgtatttatcacatttggatgggcctaaatgtaattacttgaaaatatttaccattgattaaaaatgtcacattttgtttaatataggaattataaatacaaatttaatcaaacaattaaaatgaattccttgctgaatcttgactggttggcaaatgaaaaggtacactgggctagacatcacttgatctagttttaaaagcagttgtgtcataaaccaactatgtgactttgcataaatatttagtttttttatctttagattatttataaaaattaaaaaaatacgtggaaacagtgaagcattttataatcttgagatattacaatgtctttagggaaaaaggtttcctccagttgacaataagttgacttatacaataaacattttaatcctaagtaataatcttctaatgaatagactgcattacatattaaatcaaattccattgtctgtcttaaagtgattgcaatgtgacagttcttattaaaatttaaataatcttatttcttggttatttttctaagaggaattttcatttgtattttccatgaaagtggtggttttgcttcagtcatgagaatatgattcattttgaaccctagaagttgcatccttgggtgtcatgctacactatgattgaatgagtaccagacattagatctgtttcaatgcatttttgaacgttctggctgttcccccttggttgttgctgcatccttttctaataaactatattaaataaaaatgcaaacaccataatttaaaaccctaaagctaaaatcatctgtgatacaatgaatgtgtgtatgtgtggtttatgatatgaaattgtatgtatatgtatctatatatgtgtgcatgtatgtgtgtgtgtgtgtgtgtgtgtgtgtgtgtgtattactcttgttgaatttaagcccctatggtacagaattcaaattacacagagctcagaaatccttctaaacatctagtacaagaagaaaattgggattagggaatcagaattgatgatgggaccaaaaatgggtcagaccgtccaaagaatatatcccagatcagcatcttttcgaattaatccagtgagtctttacttactcgctgtaatttagttttgtaaaccaatgttgttttgctttaaaaggccgctagttacatctaagctattattgcttatgcagtcagtgagatttacttaaatgctttaggtgctttatttaaaatcagcataaaacacagattttattttagtgtggtttttgccttggttttgcttgttattttattttttcagcgttggaaacatatttcaatgctttgagctatagctagaccacccacaaactaggcacagttctgccctcagagcctatacttgtaggaaggaagattatttccctgtgccagggaggttgagaatgcagaggcagagggagcaccttcctaggtaggcctcaggtagtgttaaagaaggcatggtgccaggagggactgagcagcaggtcctatttccttgaagagggtggccttggtcatagtgtactatgagtttagcgggtttgcacctggcattggaataagcccacgggaaaacagtcttactaatacaatgattaaatccactttcacctccccagaagataagcattatttgtagttatctagtcatttctcctacattctcatattctaaattagaaaagcatttgttaatcccagcagtttatgttttgattttgttttcactttatcattcttccttttacttcttatactaatagctctaactgttccttgtcctcatctaatccattgcttcccagatgtctttgaaaagaatgacttgagctactggttaaacatagctttccagacatcttcaatggagaacatgattctgtgggtctgggatggagcctgggaatttgtattcataacaagtacctcaggtagttcttatgggagatgtttaggtaatgctgcctgaccttgagagctcagcgtggcaatgcaacccacctgtgggtagagggccagcttaggaaataaaaatacaggaggctcatgggatatgcctaggctgaaaatagtccattgtttattggaaatttaaatttaactgggtgtcctatctggcaacctttcctgtggagaaaatagattcgtggtgcagaagtagctgttcaaatttgttacctggggccagatagagtctgtctggccaggaattagattagagttctcttggacttcaatgcaggtgttacctcagaccccctctgtgtgccctgatttgctggcttttttgatggagcatggtgttgtgggttaaatagtgtcaccccaaaatacatattttgaaattctaaccctgaatacctcggagcatgagtttatttggagacagggattttcacaggagcacaagttaaaaatgaagtcatttagggtaggctctaatacaatctgattgatgtcctataaaaagcagtaatttgtagacagacacatgcacacagggagaagagcatcatgtgaacatgaaggcagtgatcaaggtgatgcttctactggttaaggaaccccaaagattgccagcaacccacccaaagctagggcagaggcctggaagagattgtctcttacgggccatagaatgaaacacccgtgggcttgcacctctagccttcaacaggaatttctgttgttaaagccaccctgttcgtagtactttgctagggcaaccccagcaaactaatgcatgtaatgcaaactaatagcctttgtagagtagtggtcatgtgccagatactttatatggagtatctaatttgatatttatgataacgagtaagttaggcactattcattaactccatttcatgaatgaaaactaaagctcagtaagagaacatgttgtggtatagtcaaatagtagctacccactaagtagtagaaccaagaatcaagaccaggtccttcagttccaagcactgttttctatacttctagacaagaaagatgcccaccagtgtataacattgcaaaaggctgaatgaggaaaaggaggcgctctgttgagttagattgtcttcttgttgctctagaattctacattttgtttcacacgttaattttgcatatgtgcacatgaatcagtaatctcttatgtgggcagggtgacaccaaaatgcctttgttcatgaattttaccaagaattaaaggaatttgctacaagtaaggttttcacattattacagacattcttatttatgctcttttagttttgcccttagaccagaataaacatggttaaatttaattcctgagttttatgtccttagttcctaacagtttccctaaaagattgctggcaagaaaacctttctgatgcagggaataatacaaattttacctgttcctttctcttgtgtcttccccaacctctgagatttgtgacacagacttttattcctttggattttcactgtgatatttctattccagcattttaacagttaatgtttgcttcatgcgctggaaaggaaggtttctcaccagaggtgatttctggactgcagagtgtgtggctcatgagatttattatttttattgggtggaggagtttctccaggctatttctgtgaatgagagatcaaagtcagatgggatctgacaactttcctctgagaaggaccacccaatagtttgctagttcttgtgtttttccaccacatggtggttgatgtacccaggatccactgccattttgttttgaatgagagtgcatgaagaaatctctatttctgctgttttttgtgtgtttgtttttttaccaattttattattgtttctttcaaattcgtaaaaatttccagtgttcttcctcctcaaaccccctcctcagctttctttttagctaatatttgtttattattccttcatctgaactggagttaaacttgactttgctgcttgggtggggaggtagcaggcttccctggtctgcatcctgggttaaggagccaagactctcttgaaatgaagttggtctcctactttcagcagacgagtacttttatgagggaagtgtagtgtgttggtcaggccttcagttcctaagcaagggtgagacatgcaagagtctagacacatatggggtggagttgatgccctgattctgaaatagctgaatgaggcaagtaatcaagaatgaaatcaaagacaccttgtaaaagccagatagcccagtaagtgagagaccagagttggatgcccaagtgttcaaatagtggaacctgaggatcaaccttactagacatattttttttaactttttcagtgttaatcttttaacagaatcataaagaaggtaatttagctatctattgctatataacaaattacaaatatgcctgaacatatttttttacttagcttactctggtgggtataagattgaatatatggtagtttgtttctactccctcttacagaatttactttctgaattactagcagactttaaaataagatgttgttacatcatatttactgattctccattaaactcttaatccttagctatccaatatgtacatatctaaaagaaatatatcaatttattgtgaattggtttatatgttaaaatcacagattatttatataatggcaaaaaaaaaagaaaacaaaaaaaagtgttgagagcagatatctctgcctattttccagtcttaggagatgtatcagtcagggatctccagagaaatagaaccattgaaccacagttgtttacacacacacacacacacacacacacacacacacacacacacattaccacaaatgtagaagcttaaaacaacccatattttttatctcacagtctctgtgggagtctggcatagcttacctctactcagggtctctcacaagttagtcaatgctgaggtctcatccaaagactcacatggggcaggatctgcttccaaaatcacttatgtggttgttggtaggattcagctccttgtgaactgtagggttgagggcttcagctcctcactggctgctggatggaagcttccctcagtttgtgggcctctccaatatggcagctcacaacatggaaatttaacttcatcaaagccagcaagagagaggacctactgcgagaaatgcatccaaggtcctgccccagctctgtggaaaacacaccccacttctgcagccaacacagcagacaggtttctggccttgcctgagcacaccgcatgggcaggagcagtgtgactccacactgcccaactgattgaaatttctgaggttctctctttccatccatcttcttccaggaggtcaccccagatttatagagtttgtgttggtgatggcttatccctgtaatctcagtgctttgggaagctgaggcagaaggattgattaaggtcaggagttcgagaccagtccagacaacatagtgagatcccatctctaaaaaataataataaataaaaattaattagctgtgggtggtggcacaccacatagtcccaactactcaggaggctgaggcaggaaggattgcttgagcccaggagtttgaggttacattgagctatgattgtgccactgcactccaggctgggtgacaaaacaagactctgtctcttaaaagaaaaacaacaggctgggcatggtggctcacgcctgtgatcccagcactttgggaggccgaggcaggcagatcacgaggccaggagctcgagaccaccctggctaacacagtgaaaccccgtctctactaaaaatacaaaaaaattagctgggcgtggtggcaggcgcctgtagtcccagctactcgggaggctgaggcaggagtgtggcatgaacctgggaggcgcagcttgcagtgagccaggactgtgccactgcactcccgcctgggtgacagagtgagactccatctcaaaaaaaaagaaaaaataaccaaagtttatgttatacccgcatgccattttctcagaaaggtcttgcctgtccactctctctaaaatgcacccaccgccaaacacttccatcttttaatctcttaccgagttttatggtttttttttcatgagaatttatcatgatctgactttattgtgtttatcattttttccttctaccccaccctagctaagtgtagatttcttaagaatttggactggatatattgtttattgctataaccccagagcctagaacagtactctgtacactaagatggtcagtagaaatttgtttttgaatttgtgaatgtctttatggcagagatattaacactacttggatatttctgtactgtcttctaaaatgctactatttaaagtaagttttttaaaatttttgcttctaccgcatagaacataataacagttttctatagctgcacatagcctcccctaagaagctctgtagtaaacatttgaaattttcctgcctttttaacgtgtagattttttcatagctctggtgtcactttgacaaaatttgaatatcagttgtatcactaaggtattgctcacctctaaactcacgtaatatgcctgaacatatttttttacttagtttactatggtgggtataagattgaatatatggtagtttgtttttactccctcttatagaatttactttctgaaatactagcagactttaaaataagatgttcttatatcgtatttactgattctccattaaactcttaatccttagctatccaatatgtacatatctaaaagaaatatataaatttattgtaaattggtttatatgttaaaatcacagattatttatataatggcaaaaaaaaaaaggaagaaagaaaacaaaaagaaatgttgaaagcagatatccctgcctatttcccagtcttaggagatgtatcagtcagagatcttcagagcaacagaaccattgaaccacagttgtttacacacacacacccccacacacacagattttaagaaattgaggaactggctctcacgactgtgggaaccagcaagtctgcaggcttgggcaggctggaaatttcaccaggagtcattgttgcagtcttgagtttgaaggcagaattccttcctcttctctgaactttagtcttttatcttagatccttcagctgattgaaagaggcccacccacattttgggggataatctgctttactcaaactctacagatttagatgttaataacatacaaaaaatttttatgacatctggtctggtgtttgaccaaacaactgggtgccatagtctagccagcttggattaaccacttaaaaattaattatcccaggtaccgtgtgacccagcagtcttactcctggatatttacactagagaaatgaaaacttttgttcacacagaaatatatacatgaatgttcatagcagctttatttgtaatagcctcaaactggaaataacccatatgtctttcaacaagtgaatggataaacaacctgtggtatatccatacagtggagtactactcagtggtaaaaaggagcaggtcttgatatatgcagcaacttaattggatctcaagatccaattatgttgagttaaaaaaaaaagctaatctcaaatgattacatattcctgaggtgacaaaactatagagatagagaaaagattaatgactgctggagtttagagttggggagaataaaggctataaagggatagcctgaggcagttttggggtagtgatggagcagttctgtgtgccgactgtagtaatagttacatgaatctataatgcaataaaatttatagaaccacagtccctttcttcctctaaaagagtgagttcatgatggaaaaactggtagaatccaaataaggcctgtagttaacagaattgtaacaatgccaattttttgttcttgataattgataccatggttacacaagatgatatcattcggggaacctgggtgaagaatgcaagaaaacttcctatttttgcaacttctctgtgagtcagactaattcgaaattttgagttttttggaaggatggaggaagaattgaaaaatctacagatgttagagaagtcactgataaatggcaaataggtgggcagaaggcagaagaaataacaagagtatagcactgaagcgggactgaacactgggggtgcaggtcagtgaggaaaatggtgtattgaaggtccatgtgttgagaagcagtgggcaggaagattggatgcagaggatagtgccctcttagacacctcagttgcttgctcaaggcatttgaaaacttaccttcagtggggaaaattgggagtgttcatgggattcttcactaaatgaggatccatcacaatttaaaaagacatttatattttaggtttaataaatgaatccaaaaaggctatcactaagcatctgattgtattgcttctaccatctcctttctatcaattattaccagttcttccttaaaagaaaggtctcactgtgtataaaactaccttaggactaaagtataccaaaacaataacaaaaaaagacaagatcgggcgcagtggcttgaaaggctgttcttaataatgttgttactgaagtattataaaagcattcgttcatttgtctttttgtttgtttttgtttttgttttgagatggagtttcactcttgttgcccaggctgaagtgcaatggcatggtcttggctcactgcaaccttcacctcccgggttcaagcgattctcctgtctcagcctcccaagtagctgggattacaggcacacatcaccacgcccagctgatttttgtatttgtagtagagatgtggtttcaccatgttggccaggctgatcttgaactcctgacctcaggtgatccgcccgcctcggcctcccaaagtgctgggattacagacatgagccactgcacctgaccttgcctttttttattattgttttggtatactttagtcctagttttatacacagtgagacctttcttttaaggaagaactggtaataattgatagaaaggagatggtagaagcaatacaatcagatgcttagtgatagcctttttgtattcatttattaaactaacaagtaaaagtgtataatacaaagtatacttgttctgtgattgcttatggttatatttatatcacacatttttcttttttatttcagtaggtttctggggaacagatggtatttggttatatgaataagctctttagtggtgatttctgagatttcggtgcacctgtacactatacccagtgtgtaaatttttttccctcactcccatcccaccctttcccctgagtccccaaagtccattgtatcattcttaagcctttgcattctcataggttagcttccacatatgagtgagaacatacagtatcacatgtatttttgaaagattaaatatacttgctgttttctgaatgtttgtgtccctccaaaattcatacattgaaacctaatgactaagatgatagtattaaggaatggatcctttgtgggatgattaagtcatgagagcagaaccctcatgagtgggattagagaccctatgaaaggggcctaagactctactaaaaatacaaaagaattggctgggtatggtggcacatgcctgtggtcctagctactcaggtggttgaggcataagaattgttttagcctgggaggtggaggttgcagtgagctgagatcacgccactgcactccagccagggcgacagcccaagactctgtttcggggggaaaagaggcgtaagagagctacctagcccttattgcccttctgccatgtgaggacacagagaagcctccatctatgaggaacaggtgctcaccagacaccaaatctgctggcacattggtctttggcttccaagctaacagaattgtaagcaataaatttctattatttcttaattacccagtctaaggtattttattatagcagcccaaatggactacagcaataccattcaactatcacaaactttacctgttttaagacatagttgcaaaatggttatttttaaaaaagaaaatgagaatcataataaccttgaatttcgttagaagatatttttatgagtttgtgatatttggggggctatattccagtaaacaagtctgcctgcttccttccgattggaagctgtaacacatgctcattcttgtacatcacaaaaagcatgaagaagaataaaacatacacattctatgattctacctagatgtaaggactgtacaattttgtgtgttcttctaaacatttttaaggcatataaatacatgttgtttggttttgattttaggctggagttgataattctcttacttccgcttctcagtttctttacttactcatattcctatgcctaaatttaatttgcacatgggaggctatgtaaaatgatgcttcctgatggggcattaagaaaacactgatcaattcatcttccttgtgtttgtccctataagatgctgaggtgagcaagaatgcctgcatttagtgttcatgggcatttccaccctccagtattggccaacagcaatattgtgcttatcatatcctggaattcctcacttcttcagtcaaaacaaagtgttctcactacagaagaggttctgattaaatatgcgtgcttaatgatggaagtggttttccgtgagaactcagcaaaaactaatacatcaatagtcatgtgggttactgcagggaaacagaaacagagtattaaaggggacagaattagccaggatgtgactcaagtcaggatggggtctacagcatcattagctcctatccattttgaaaagaggaaggataactgataggtattagaactgggcactaggcactacagaacactgtagacttttcttcattattcacagtagatttaaatcacgatcagagacattgctatatccacaccatatttgtttgctaaatttatgatttaattatttgcacatctcttttctgggatgaaggaatgaagactgctcattttgtttcttttgtttaatacttaagttctggggtacgtgtgcagaacatgcagttttgttacataggtatacatgtgccatggtggtttgctgcacccatcaacctgtgacctacattaggtatttctcctaatgctatccctcccctagccccccactcccacttacgagtaagaatatgcggtgtttggttttctgttcttgtgataatttgctgagaatgatggtttccagcttcatccatgtccctgcaaaggacatgaactcattttgtttcttatgtgggtgttcatttggtattagcaatttataatcctgtacaatgggcatgattggtatttttttggctgcccagcaccttttgaacaccttactataatctgggggaatttccaaccttacgagaaccatcctcccacaatagaactcagagaactaatctgctttgcacctagggcacaagaatgtaacctagattccaccaacaaacctaagttctgaaatgagcaatttgaggagagaggctctgcttagattccaggtttgctagccagagtggtggtagtggcatctggctcttaggggtggtcgtgtttacagtgttgaattcttggtgcagctgaaaacagtgacagttttctcattaagcctattttgtgctggattggggattgttcctagaagcttagtattgagcctcattcttaatatccttttaataaactcctttcctgtatgattactcagaaccagctgctgttgcttatgactaagtagttgaaagatcaattctcagttagcactgtgaagcatctcttttggtctgactgtgttttgggtgagggcaaaggacagggtctgagctcaaaagttgaataatgtcatttctagaacgagacctgaaaatgtacgcctacaagtaagaagtgcagactgagttaaaaataaaggttttatgagaaataggagcccaccataggaaaaagtaactccaagatgagacgaggatagggatcaaagtcagtgaagtgaatagaataatcagactcatgcttgactgacaagttgaaatccgtgtgatttttgtcttggcattagaaaattttatattgcaatactattctttgattcccacttccctttgtcatatttccaagattgtaaatcttaaaatagtttcaaagaatcagattctttgttcactgtatacagaattaactaaatcaaaatcatgtttattgtttttaggattatatactgccatccacaattctatttagttagtattaaaataataatgctaattttctaattgtttgtgggctgtatgcccaagaaagcatttacaatgaaaaaaattcttccgggagctgtgaacctaagaaatcattattcaaatactcttagtttagtagactgattggcatattgaaacattcacttaccctttatatagagagatactggcccagtcattttggaatatggcagtcaggaagcagtgttaccttaacaatatggccctaactgctaaatgtgcatgtctttcttgagattcagatggttctgatggttaaagcccctctcctagatatgtaactgaaagttttctctttagatttttatattagataaaaaaagcttccatttatcaagggtcaactgggtgcagtcattgtttggatgctttacataatttatctttgagccgtacacaccccagccagccaggttgttacacctgtctttaaaaaaaataataaactggcaaggcacggtggctcatgcctgtaatctcagcactttgggaggccgaggtgggcggatcacgaggtcaagagatcaagaccaacctggccaacatggtgtaactccatctttactaaaaatacaaaaattagctgggcatggtggcgtgcgcctgtagtcccagctactctggaggctgaggcaggagaatcgcttgaacccagggtacagaggttgcagtgagccaagtgcaccactgcactccaccctgggaggctgagcaagactccgtctcaaaataaataaataaataaaccaaacaaacaaatgaactaaggctcgagaggttacatgacttgctcctggctatccaggtttattttaagttgatgtttcagagcaattttgtaacctaaggtacttttcttaggaattttaatagttacctattcccaacctcatctcagtgtctaagtagaatggtcctgtggtgcatcctagtttctatcaaccctcagcctctggcccagctctgtggcttgatttcacaggcttttagcaactggcagtaactactaagaatcacttcatttcattgcctattggtgatgtaatttctcagatttgggctttactttctgtagttcttattcttcctacttggccaaaacagcaaatgagtaagagaatgccatgtggaaaatttaaaccctccctccgtagtttctcaacaattgcagttatctctactattttcttttaggaaggaagaataagttaaacttttcttctcaggttgagggatgccaggcctgatttgcagttactttagcggccttagtttatttgtgtgctgtaactgtcaatgaagtacctcagatggtcctgggctgtcttcttaaaagcgcagaatgatttgaataaagtgtagtgggatacgcgaacaaaattcaaactggttttgtgataaaggcatacattctgagccaatgccagagaaaagaaccatctcaaacttatttgaaccccatggtactatttttggaacaaatctcgtgttcgaataaatcactgccccatcagcattcagagggtctactgcacttccataatgaatcacatattcaaagtcagacacgaaaggaatcattgtaaagggtttttgacattttaggctacaaagaaatcctggttttgaaatttttctttcttcaccctcttacagtattcctgattgctgggaagtttggaaggggtaggagaggaacatgagaaaacaatgaactcacctaagacgcataggagccataaagaggggacagtatctaaattaagattttaagccattgtacatctagtaggatagatacgtgtatgggtgtgtgtactattttgtgacaaataacaggcaagctgctgctgctgtggtgaatgaatgggaaaggtaaactgaggggtgcttactttccctatgcattgcaatcattattaagctttaatcgagtcaaacgactcgtgtgtttcacccaaaacaacaatcttcagtttataagatctgacttagaaccgggatgagaacagagacatagaagtttgtatctgtagttatttaagtggtaacccatcacttgggaagcttttgttcattgcaaaaagtttgttttaatgagtccatataatacacagaaatttccataatttaccaaatgatttataatttaaactgcatctgtatatcctttgagatgatctattaaaatgaatgaatagctcaagttatgtttaaggcataggtcataagtttatttaagaattagtcataagagtatttattaggagggatggtatttgactcaaatactttgaaaacctagaagtcatagaagaaagataaagtgattttaaaaggtatttgggggagaaaagcatctgcatataaagtcttctctctctctctctttttttctttggtagaaacagggtcttgccatgttgcccaggctggtcttgaactcctgggctcaagcaatcctccagcctccgcctcccaaagtgtgggggttataggcacgagccaccatgcccagcctacatataactcttgggtacaggtatacctccttttattgcactttgctttattttgctttgtagatattgtaagttttttcctaaattgaaggtttgtgtcaaccgtgcttcaagcaattctctcagcaccgttttttccaacagcttgtgctaactttgtgtctctgtgccacattttggtatgtctcacaatatttcacatgttttcactattatatttattatggtgatctgtgatcaatgatctttgaggttactattataattgttttgagatgccacggactatgcccatatgagatggtgaacttaattggtaaatggtatgtgttctgactgttcccccaccagccattcatctccctctctctgtctgtctttcttccagcctccctattgcctgactcacaacaatattgacattgacttagaggcctacaaaggcctctaagtgttcaagtgagaggaggggctgcatgtctctcactttttgtcaaaagctagaaatgggcaggcatggcggcacacgcctgtaatctagcaatttgtgaggctgaggtgggtggattgcttgacctcaggagttcaagactagcctgggcaacatggtgaaaccctgcctctacaaaaatacaaaagattatccaggtgtggtggtgcgtacctgtagacctagctaccagggaggctgaagtgggaggattgcttgagtccaaggggcggaggttgcagtgagctgagatcacactactgcactccagcctgggtggcagagtaagaccctgtctctagaaatgattaagcttagtaaggaaggcgtgtcaaaagccaaggcaggctgaaagctgggtctcttgtaccattggtcatgttgtgaatgcaaaagaggttattgagggaaattaaaagtgctactccagtgaacacacaaatgataagaaagtgaaacagccttattgctgatatgaagaaagtttgagtggtctagatagagttagccaggtgtggtggtgtgtacccatagacctagctactagggatgctgaagtgggaggattgcttgagcccagggtgcaaaggttgcagtgagctgagatcacaccactgcactccagcctgagcgacagagtaagaccctgtctctagaaatgattaagcttagtaaggaaggcatgtcaaaagccggcaggctgaaagctgggtctcttataccgttgggtcatgttgtgaatgcaaaagagaagttattgagggaaattaaaagtgctactccaatgaacacacaaatgataagaaagtgaaacaaccttattgctgatatgaagaaagtttgagtggtctagatagacgatcaaaccaaccataacattctcttaagctaaagtctaatccagagcaaagccctaactctgttcaattctgtgaaggctgagagagatgagcaagctgcagaagaaaagtttgaagctagcagaggttgattcatgaggtttaaggaaagaagccatctccataacataaaagtgcagggtgaagcagcaaatgctgatgaagaaattgcagcaattatccagaaggtctaagaccatcgatgaaggcgcctatgctaaacaacagattttcaatatagatgaaacagccttctattgagagaagatgccatctcggacttttgtttaaatggcaacaaaggattttgagtattacataaacttagttgctaaggcagccagcagggtttgagaggattgactccaatttgaaaagcagttctgttgtgggtaaaatgctcatgctacagagaatcttttgtggaaggaagaatcaaccaatacagcaaactttattgctgccttccttgaagaaattgccatgggcatcccaaccttcaccaaccaccaccttgatcaggcagcaaccatcaacattggagtcaagacctttcaccagcaaaaaaaaattacgactccctgaagtctcagacgatcgttagcattttgtagcaataaagtattttaaaatcaaggtatgtacactttttcagacatgatactattgcatacttaagagaccacagcataaaaataacttttagatgcactgggaaaccaaacaatttgtgtgactcattttattgtgctatttgctttattgcactttttcccttattgcagtagactttgtcatgtgaaataattaactctctggcttatattataaattctatgttagtgatgtttaggaatgtacttactatagaatatactgttataagagtagagaaataacaataccttgcttaataaactattaaggtgaacttattttacatttttacttctcagtgagaatacatctgataatttagggaatttagtgattatgtaaaagcattttattgttttttccttagtagtgcattttttaaaaagacatgttttacattgttggtatcttggattccagaaaatatagaaatcttcttttaaatagacttaccgataaatgatactaatgataacacataggaagatactagaacctctatcaatagtcaaaatatcaagccaaagatattagttacagagtactgtgacattttcaacactattatcaattttgttcctctcttttatgattgagtgatactccatctaaaaatgggggaagacattaatcctcattatctagacttaaatgaaagtcttgacaagttccaacatattttttctataagatttttagaaaaataaattggtacatctttcaagatattacacagagctctgttaataacctgaggatggttttctgaagatgatattgttagcttggaacaatattgccttttatttagtaaacaatgaaaaacatacaaaggatattgatacatgacatcagtatgggagaaattgatggcatcaagagaataaaagaatctatggaaattcgctgcagaagggttggtaaaaaatctaactatatggtatgttgaactctatagttgtttacataaagaatttggactggacactgacccagcaggaaaaaataatctggtcagtacacttatttatgtcaaggatatgttgatcttgtaagagttaacattactttgggggcatataaatattgagaaatcattctaatattacactgtggagaaattcagtgaaaatggttaaaaaaagagacttcaggaaaattaaaataagttgaaattgtttgatttggacagaagaatcaaaagattaggagttacaaggagaagaggcacagctgttctctatttctgtgaaaacagagtaaaaataaatgcatattcatgagaatggaaaatatgcaggttggttattggaacagtaccagaaagaagaaggggcatcttaccttggaaattttgaatgcaatatataattgcatctgataaaaactgtatgtactcattcgatacgtatgcattgaatgtcttccatagaaaagcctaatattaagtgttgattcctgtttgaatataagaaactaaaccagggacttgatagaaggtgtccatcatagttctgtgacttttatgaacatagtgggctaagtgagacttcttgagaaatggaaaatcaatttcataccctttcagtaggtaatataccaagatgtttctatatatttatatatatatgtttatgtatatttacatatatatttttatatatatatatagagagagagagacatgaatagaatggctctatagagttagtcaccctttggtatcaattaagctgcccatatctaaatgtcttttgaccattccttaagaaatgtcaagagaaataagagaaagttagtaatgctgctcatattttctttgtcattatttacagtgtattatgcatacagtgtaatccatcagccaactttaatttcgtaagctattcattgtgtttaaacagcgcctttcttatattaaatatttatggcagtctttgggaagaatacattaaaatagcagatgggggtcgttttaaacatttccttgattgaaggcaggggacccccttgtgaatttatagtctgctttcaaagaaagttcacaatgtctgataacccaaggaggcaagaattccaccaattcccagcactgtgatttcaaaaagcaatggctgcaaacagtcttcatgcttcagcacctcctattttgaaactgttagcaagagcagtgaagaacggtgaacaaaaccgtttacagttgtattgcctattaataatgcaataggagtacacctcttttgcattaatattactttttaatcgatttttaaccatagtagcaaaaataagtggaaagtcaaacctttgacctgcggtggacaggaagatgtatcctagactctggaattctgattctggaatttaaaagatgtttggggaattatgtcctaggaaacgttttctaaaacaggaatgtgcttttttgctttatattttctatttgccttggtaactaagaagtctgaatccaggaataatgtttttttttcccccaaagtagtctcttctcctggtttaagcttataaacactatacatctttaattatattattttctttagtagttatcttgacctttaggagtgttactgaatataaaaattattctatcagtttttattaaaatcttagattattagactgtataatttgacttcattatcatttgataattgagatgtttcttaaacagtcttactctgttttttctaagcaaacagcttgcatttgatgcaaaagggaaatgttttgtctctgaaaaatcttatgtagctttaaccaactatttcattaatgtttggtgagagctctgatagtttcaggccagggaaactatgactcttgtagtacttaagacacttgccaatcaatagtaaccatcctcagctgatggagtgatcgttttacaatcacatagaatgtaaaggtatcatggaagggggaaggtgccacgggcaggctggtaatatcagagtctctttaaacttatattttgcaagtaattgttcaatagttcttcatgggatgtgaagaaactagttttctagtggtaaaaattgtatacctttgtttttaaaaatgttttattatgtgcagtgattgtaatatcacatttaaacatagcccaggagtttttcacagatgtgctctcaaggatctgtgaatcacctgaaatatcaaacccatgttgtatgtagcttgtttttggaagggtatccttagcttccatcagtatcaaaggggatctctaatcccaaaaccttaagctgatctgatctaagatctttattttctagatgaagaatctgagatctgacaaaatcaagtgactaatttaaagtaagacagtattgaaagaactacaattaaaatcgtttattctactggagattgtccatgaggtttacaatattcttttttttttttttttttttcatttttgttagagacaggatcttgctatgttgcccaggctggccttgaactcctagcctcaaaccatcctcccaccttagcctcctgagctgctgggattatagacatgagccactgtgtccagttctccagtattcttttataagttagatgttaatactgtagaattgaaaaaaattatgaacctttttcatacacaaatctattcaactcaaaatacttacgaagtcgagtcctggattcataatatctcagcatattgttttgagttccatctgagcttgaggatgatatctataaagccagccaatattaattacatcttcaagtgaaagtacattacccgcctccctgcagttttaaccctatacagtggaagtgtagcctttccttcttccaggaattgttagcataaatcctgacagttccagacagtatggaaggatcccagtagatagggaaaagatccccactcgaaggtccaagcctagtgggatacctttcctgggcacatggtgccaagagatgacttaaatatctacaaccacttgtcagctcagtttttttggggactactccaggtcttccctggggaagggacacatattcttcctggtaataaagattaaccttgggggcaaggatagcattttcctctgcagcacaacgtaggagtaaatggaagggaaaacccaggaaagcagaggtgttccctcacagaggcagtggtagaaaaagtaaggtagaaaaaagcagtaagacagggatgtttggacaaggcactcattcataagaaaggaatgatagcagattggatgttttttgtttatgccttatgtatttgacgttactgccagtgatttttgccttacatctgaccttttttaacgttcaaaagtgtcaaaatagattttgttgttgttgcagttttgtaatgggcgggtgtattattatcaggatggaggctgatttattcttttaattttattttttgctggctgacacctgaagatctactagctctctgcctctacggtcaaagtgtgttcttccccactgacagttgggctgctgatggctccttttaattcccatcagctgagggctgactcagtcaacatcttctccccatcctggaccccaaagaatacaaggaaaaaaggctcagagacttagcacattatttttgttttaagatgtcagcacctgatgtattattttagtgcttgtttaaatattctgaaactgtgttttcttttttcctttaatttaaatttgtcttcataaagttggcttacaagaacatttctttatcaagtttatctggattttctgggtcaaaagtataagtgatttctggacttttcttgacaaaaagtaccaagaaaagctgcattaaaacaacaaatctaattttaaaaacacttagtgagctaaaacgcagactcaaaccaaactaatgaaagctatttaagagaagtcagttgaagtagtttccagaatttatttcattgttttttcaactctttgttaacaccataaacgtgaattaaaaaaaaaaaaattaacttgtttttgaactctataaaaagtatttttttttcttttaattaacttcattgttttttaaagccctgccaagctctatttctgtgcttgggtagttcccatttgcaaatagggcaatttctgcatataggtctgaacaggctatgccacaattatcctttttattgtaactttactgtcaaagaagtagtttttgtctccaaatggaaattccagagtaattcaaatgccttagtaaacataatgtcatttcgtatttccaaaggcaatggccgctggtccagtaaacaaaacccatgtcgaaacctggagtggacccacatcccctcattgttactttagtatctttcataataatgacagttgctaggatttgttttttaccaagtgccaggaagagtgggaagtgtttatatggattatctcatttaatgtttacattaactttatgaggtacaggtattatgtgtatttttttttttttttgagacaagagtctcgctctgttgcccaggctggagtacagtgacatgatctcagctcactgcagcctctgcctcccaagttcaagcaattctgctgcctcagcctcccgagtagctggaactacaggcacctgccaccgcgcccggctaatttttgtatttttagtagagacggggtttcaccatgttggccaagatggtctcgatctcctgacctcatgatccgcccgcctcggcctcccaaaatgctgggattacaggcgtgagccaccgcgcccggctgcgtatcttaatctcatagaccaggaaacctaagctcagagaccagtaattaagctgccttggctacctagctagtaaacagtagaaccagaattctaacccagactgactaaagcttagcctaactgcatcactgttttatactgacatatgggatgtacatttaatgatatatatgcaatagttttctagttataattcatctttaaagtcacttgagcttggaaaagttgctacatatcataattggcctcgtgccagacaccaggccctgtgctatgttctctactggtaaatttgctgtcattgaatggtaagaatccagtgtcaccatacaattttacaaataagacataggagatattaatgtcctcatcgtcattgcctggtaagaggcagagtcaggggagtttcgctactaacaaaactattctcctggtgctgaataagaactacttgaacaagctacacaaaaggattaaagcgcaattaagttctttccaaaaatgtgtggtggcatttgtctccgtggcatgtgattatctttagaacacattctaaagatgatttccaactcacagtaatattgggaaaaaaaatttggaaaacatttgcccttcctaaaaggtgaaacatttgaagtattttcctttctgcctcatgcctttccttcctttagcaaacattaattgagaacttattatgtgctgtagtcactgtgctgtttgtacctaaatgaataaaacacagctccttacccgaaagaacctgaaaatatttttcgagcaactgtcatttcgtgcttgctttgaagtttatgaattaaggagtagaaattcagaaactcttcagtcgattgattttacagtataggttatcttcatatatttaatacacatctcaaatgtcaagttctttctctctgcgttagtgcccacacagaaccataaaatcttgcctttgtatcatatgcttatctctcccagttctttatttctttcaaccgtagtggtaaatctatatatcatggtgacacattaatcatttctaagctatttttaagaaactggagtctgtattcctttttgggatcaataattgggataaatgaaataatagtgtgagaacaaaatttaaggaggagattttaaaagtttctctgaaagtctaaaattattttctttcttgttttaaggattttgataactaaatatatataagttgttgttgtgttctcttatgaacccaccgagtgtttctcaaagttggagtgtcaggatcactggggcacacagttttggacaccatgctggacctacctaattagaatcgtgtccacccacgttcccatttgaagttgtaacatactttattggcaattctgaagcacagtagcacttcagacccatttttcctatcgattttatttatatataagcataaacagaagaaactttggtgtgggtaaaaaagaaactacaaagggattcctgctgactcatgagccctaagcctccttagatttctgttaattgagttgagacaatgccctttcccaaaacctctttccttaacagaagggaatttctacaatggttctaaactaggatggcgccagagtcccctaacaccaaattccagagtcctaaaaactttccgtttttagagaatatgatttccttgccaacaccaaaaatgtttccctaaagaaaaatgagggagaggatattatctacctagttccaaagagaacctttttactgatgaaatcatataagcctcatagaaccctcctaggggaacccagcaaacaatattagcttttattatatgtttgctatggagccaaggacctgtactagatgttttttgtgttattgaatttgattgttattgtatttagtagcctactgagatagttattatttatcctcaggtcaattaagtaacttgtccagacattgagttaatcaatgaaggagccaggaatcaaaccctggttggcagaatttcaaaactgtcttcccaaggagagaaaaaatggaatatagtgcttccccctctgaatcacaaaaactccatctcaggaagccaccattagcagtgtagcatgaaggaaaaggagtttcttcagccatcgtaaagaaagagaatcatctcctttctgaatttaagtatttaccttacccatgagaaaacaataccctttgcttcagggcaataagataattgttttggtttcaaaggtctttccttctggctcctactggattaaaataaacaaaggtgatgtttatgtcaacaatgttatttagccaaataggtggcactgtcagtgtgaaagctagatggtagttgactctaagaaagggatgagatagttattaactaaaaggagagactcaaaattaagaatgcctctgcaactgcaactttagcacatttgcctgaatgttataatgtattcactgtaaagtctagaaaccttataaatatatgactggcagttgcctcaggcagaaatcttttactgatgcaatgagataaaagtaattaagctacatgtagactgatgggtaattaaatccatgtgaagcattttgtaactaattgctatgttctaatcacagattgctttctatttgtcaaggtaagtgtatataattacaccgtccttattttctttaatctgaaatcatcctagttgggtgaatgtttttaagcaccctgaatcttagaatatttggtacatttcttgcataaaggtaatttgcatattttgtaatttaaggacgttttatagtaaaatagcttttagtgtcactaagaattctgtggtcaatagagatttctaatctaggctcattgttcattgtttaatcttttttttttttttaaatagtaaaaggttatgttatttactaatgccggtaacattcaaggcattatatatatatggactgtggtccttatcacagtagttagaaaagaccaaggatcagtaaagggattcaaaatagatttcgattgacacaggttgtaaaacaaataaacagctttgagggctcaagagtctcagattgagagagcaatatgattgaaggcatggctggatctccttgacgggttatagctggtaagacaagggcatttctagaatcaggggactagagtggatttcatctactctaagtggaagtagaaatgtggatgtagacatccatttaaagccaagttttcaaatacaagtcacctttgctgcttggtgacactagacagtgctacagatgtcttattcatctttgtgcttttagcatggtgcccagcacctggagctcactcaggtaatatttgtgttattgccatgagtaacatgtagaccaataatgaatcaacagatcattttctgcagattatcatcatttgtggccttctgtttctcattttcttagttgtgtagtctgttttctgaccttcagggcatattataaagtcactgcattaacaaaaaaaaagtcctaggtaggcatggtggttcatgcctataatcccagcactttgggaggctgagacagaaggaacacttgagcccaggagttcaagaccaggcatggcaacgtagtgacaccccatctctacaaaaactgaaaaaaaattagctggacatagtgggatgcccctgtagtcccagctactcgggaggctgaggcaggaggatacttgagcctgggaggtcaaagctctgcagtgaactatgatcacgccactgtactccagcctgtgcaagagagagagagaccttgtcgcaaagaaacaaagcaaaaccctgtacttaattacttaattccgccttatacatttttttttttttttttgagttgaagtctctgtcacccaggccggagttcaatggcgcagtctcggctcactgcaacctctggctactgggttcaagcgattctcttgcctcagcctcctgagtatctgggactacaggcacgtgccaacacacccagctaatttttgtacttttagtagagacggggttacaccatgttggccaggctagtcttgaactcgtgacctcaagatccgcctgccttggcctcccaaagtgttgggattacaggtgtgagccaccatgcctggcctgtacatactttttattacatcaaatgtttcacatcattttttattgctaatgacttttaatagctttgtaatttataatgaacttttagccttctctaagtggaaattattatgataggcatagtttactaaggctgaattgtaatatatttctttggaaaccagatccttactccctcattcttctcatttttgttgagcaattaaagttgccctgtatggtgtggaaaattagacttttttttttttttggagacatactttcactctgttgcccaggctagagtgctgtggtgcagtcttggctcactgtaacctctgccttctgggttcaagagattcttgcgcctcaagcctcctgagtagctgggcttataggcatgcacctccacacgcagctaatttttgtacttttagtagagacagggttttgccatattggccagactggtctcgaactcctgacctcaagtgatccacctgcctcggcctcccaaagtgttgggattacaggtatgagccaccatgcccggccaaaattagacttttttaaaaaatagaaacaggatcttgctacatagcccaggctggtctacaactcctgcgctcaagcgatcctccccctttggcctcccgaagagctaggattacaggcatatggattcctcttctgctcactgcacaccagacctgcttccccacactcttggtgtaagagtgccagcctgccagccatcagattttttctttcctcggagacaaatgttatgttgatttcttcacactgctgcaccttgtcccatagcttctcctttgtattagtgtagatatataataatgaatagaaatgtaatgcattttatctttactgtatctaactttaacacctcaaaaacatagaataattattcttttctaatgcctgctgacaatattatcttcacatctttctgtttgtggttatgccgacctatcttataaatttatttaacttaaagcttttctgtacatttttttaaaaaaattctgtgtcacagtgtctcataatttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccatttttttttttatatatcccttggggaacttcacatggggcttggtgacaactacttactaaataccacttgctgatgacaatggcagtactatgacacgcttcaggatgtggtctttgagtttctaattgcaaatacaggcattatcttttttatgtagtgtgtgaggcttcttatttaaagaaaaatgtgttcatttgatggatttttaaaaataggtgataattttagaagcaccataacagtagccactttaaatcaggaaactttgactccgtgctgaggaaataggttcttgatttacattagacaaagagtatgttggccctgccttacttaaatttcacctgaagctcctagagtctgttggttaccagaggtttcacgtattctgagtcctttgccctgataacccgtactctgccttcattttcttccttgtttgcttttattgtataaaaatcccagagttacagaagtgttacaaaaacagtaataagagtacatttacccttcttcaagtgttttttttctctctttcttttcttttttttaaagacagtgtttcactctgtcccccaggtgggagtgtagtagcacagtcacagctcactgcagccttgacctccctggctcaagccatcctcctacttcagctcctgggctgggactacaggtgtgtaccaccacacccagctaatttatttgtattttttgtagaaatggggtttcgccatgttgcccaggctggtctcaaaccaactgggatcaagtgatcatccctccttggcctcccaaagtgctggaattacaggcatgagccaccacacctggctttaaatgtttctattttaacatgacattatataactatcaataccagaaacttaacgttggtaaaatactattatgtaatctgcagaccctatccaaatttcacccattgtttcactaactttctttttctggtcccaggtccatctaggatcccacattacatgtggttaccaagtctcctcagtctcttcacttccaatctgggccaggtctcctgtctttgtcttttataaccgtaatatttttgaaatgtgctggtcaattattttatagcacctctctcactttaagtttgtctggtatttccatgtgattaaattcaggttatgcatttttggcaagagtaccactgaagtgattgatacgcacttttcagagcatcaaggtacatgatgttaagattctcattactggtgggtttgatttttattacatagttaaggtgatgcaaaatttctccactgtgaggtggttttttttttttttcattttaattaataagtgtcttatgggggaaatgcttaaaaactgtaaatatcttccttctgcccactaagtttagcatccatggatgatccttgcctctgacaattattacttgtggtgtttgccagatgttgattttcctatcttaccttttacattcagtaattaaaattatattatatggaagacctctgctttttcctccatttattttttgaaataccttttctgttttggactcatggatatttattttgttctatactttaaattctactactgtcattatttattctgttgatcagattgtcccagattggccattgagagcttcttcagtttgactcctttgttctcttgatttgccctcataattttttttagtactttcttactgtctggcaccagaaagtgttttaggcttactttgtactttctgtaactcaaatcctggaatcacccatttctctaagcaattcttatactttatgttgggagaacagagttttgaaaataagatatgatcgctagttgtgttcattgcttccggggtatcatcttctaacttgatcttttaaatttcgagtttgtggagttctcttggaactgatagatagccagtgcacttctatgtagactgatggtcttcaaatgattctctagtaaaattctcctttttttcctattaaaatgaaataatatttttttctcgttttaaagggaaaatggattaagttaattgatagaatcatctcaattttctgtatttctcaggaaaccttttcttcccatttttgtggctattctccatttgtgtggatatataaaagatgataaattagtgcgtaagtaggaaacattaacagaagctcaatttattatttttacaacctttttttttctgttgaatatatataggtattttctgattgtgtactttctactccaatgggaatgagcatttatgctttgttttctgtttgaaatactgtgaaaacttgaatactttcttatgttcttttctttgtaagcaaatctgagaactgcacctgtaggctccttcttcctttcatgttgtcatctcaatgtcccctcctccttttcctccttccccaacccttcatgcttccctttcttcctgtcttcttattaatttcttcattcagtcaataaataaatattcactagatgcttaatatgttctcagtcactgtcctattacaagagttagttcagtgaacaaaacagagaattgcagtcttattgtagctttcgttctatttgggggtggggtggagaggcaatacacagtaaacataattagaagtaaattatatagtatgttagaggtacttctctccacttttttctgtctgttccttcctcctgctgcatttactaatttctctccattggtcactgttggagatctttaaaataaataatgaatgaaagagaacctttctaggacctcagcttaatccttaaccagctgaagccacaggaaataacaaaaaagaactggggagttagagaatacagaatgaaaatgtatttcacaagagttttgtagaatatttaagtgaactcaagtttgaaatatcaaaatggtttttcctagaagagatttggcagacttaatagaggtaataaagcatttttaaaacttaaccagggcacttatgaaagataacaaagtaattttgctgtatttggctaagcttgggccagtgcaattactataagtactctattttctttttaaatccttgtaagtaaatgccacagtaatatattggctgcagaggagacaaaggtggagagtttctctgtaaaggttttatggaggggggattgagagatggtgtttttatcaagttaacaggagtgctttggtaatgataattcattttttcctaaacaagaaaagttgtatagatcacacctggaaatgaggagcttttaaaaatatttctattccacccatgtatggcaaattacatatcttacctattttctgtgtttcttcatttataacttataaataatggtttacagttagaagcaatttgtagatagaaatgctatttgcagtaagaactactaaatatttattttaatagtgagaattaaggactcaaaactttgaagtatagttttaaatacaatagtctctattttgtaaacactgtgaagtgtataaaatgtgtatgtccaagataacttaaagataatacacaaaatgattgttgtacagttgcatttgtgaatgccactttttaatttattaactatgtaatataatgttttgaattttaataaaatatgtcaatacaatcaagaaatatacataaatgaagcacaaaatcttatatctatcaatcatatcacttcactgtgaagaattttcagtttctgttgattaattaggagaaagtataatttattaatatatttctattatgtgaattaaaattcatgttaattcttttagttcttcattgtaggcagttctataccttataacagtgctgcccagtagaaatatatgagccatatgtataatttaaaatgttctagtagccgcattaaaaaagcaaaaagatacaggttaagtatattttaatcagatactttaactcgttatatccaaaatgctaatttcaatttgtaatcaatttcttttggcggggagcgggagatggagcctctctcttttgcccaggctggagtgcaaaatggctcaatcatagcttacaacagccttgaactcctgcctcaaccatgcaagtagctaggactacaggcatgtaccactgtgcccagctcagttgtaaaaattattttaaaatcttaataagatagtttacattcttttttcatactaagtagttgaaatcagatgtgtaccttggcacttaaagcacattttagggccaggcactgtggctcacgcctgtaatcccagcactttgagaggccaaggcgggcagatcacgaggtcaggagatcaagaccatcctggctaacacagtgaaaccgcgtctctactaaaaatacaaaaaattagccaggcgtggtggtgggcgcctgtagtcccagctactcgggaggctgaggcagaatgctgtgaacccgggaggtggagcttgcagtgagccaagaatgcgccactgcactctagcctgggcgacagacggagcaagactccatctcaaaaagaaaaaaaaaaaaaagcacatcttagttcaaaccaactgcatttcaagtgctcatcagccacatatggcttgtggtttattggatagtacaggttttattactcttaatgcatctcatgttatttacacattgttttggttttcttcaatcatttcttatttctaatgctactaaagctggcttttgagatttttggttggtactactcatatcataattatagtcagcattttataggtcttctccttgagtcactaaattggcattaaaaacaattatgttggagttccttcttggaaattaagagattaattctaatccatgctgtgctgctgcttattgtatcactttgggcaagtctgttaacctttctgtcacagtctctatttataaaatgaagtggataaagagttttggcatttcaaactggataattcttattttaaaaaattgtctgtgtttgttattcaaatacattgattgattacactcatatgcattgtgttacccatagtgccaaaaaaggtttatctactaggatctatttttagtgaacgatggtgataagccatgaagagggagagaagtatccttaactgactttcaagcacagaattattaaaatcttacattatatctgggtacaaattggagagccctgaattggcactttggggcaaagaaaaggtgagatcattgaagttgttggtttattgttttcgtcagtgctagcaactaagtatgttttacctttttgtgaaaagttgaattattggcgataaggaattatcactttttttccatgaggtagttatttcaaaatgacattctgcttttccccttcggcaagaggataactaacatactattttaaaatactgaatattagctctctagattagcctctcatagcagaatttaataatgatcattgtacttaattagcttataagacagcttatgtttaacacatgtagacttcatttgttgatttagctccttttagatgttttataaaatagaaaaaagatggactttaccaaaattaccactttgattgattgatggttgccctcaggtttaaatatatacccttagcttatcacaatctacgttcaaataatattttactacatcatttatagtgtaagaaccttgtaattttatatttccatttcctcttcttgtcctttgtgctattgtcagttttttgcatcaagtgtaaaccccaaaatatgttattatttttgctttaaatgtatatatatacttttttttttttttttttgagatggagtttcgctatttttgcccaggttggagggcagtggcgtgatctcggctcactgcaaccttcctctcctgggttcaagcgattctcctgccgcagccttccaagtagctgggattacagttgggtgccatcatgcccagctaattttgtatttttagtagagatggggtttctccatcttagtcaggctggtcttgagctcccaacctcaggtgatctgcctgccttggcctcccaaagtgctgggattacaggcgtgagccaccacgcccagctgaacaattatattttaatggtggctcatgcctgtaatgccagcactttgggaggccaaggcaggcagatcacaaggtcagaagatcgagaccatcctggccaacatggtgaaaccccatctctactaaaaatacaaaatttagccaggcatggtggcgtgtgcctgtaatcccagctacttgggaggctgaggcaggagaatcgcttgaaccaggaagtcagaggttgcaatgagtggagatcacgccactgcactccagcctggtgacagagcaagattctgtctcaaaaaaaaaaaaaaaagattaaaaattatattttatatatacccacatgtttgccatttctggtccaattcttttctttgtgtgtcatctggtactctgctttttatctagtattgtttctctcctgtttaaagatctttctttattagtctttggagtagtgctggtattgagttcactcagctttgtctgaaaagtcaacaaaaatctaggttaagagtgtttcagtcttttgaggttatgtctccattacactctggcttgcatcatttctgacaagaagtcgtctgtcactcttttctttgttcttgtatacaatattgcttccagcccccagttgcttttaagattttctcctcattaccttgttttttcaaaaaaaaaaaaaaaagaaaaagaaaaaaagaaaaaaaaagtaatttgtttgtgtactttgatgtggcttcttttgtttattctgatgaaggtttattgaatttattgaatctgtgatttatagtttttgccaaatttggggtaaatttagccatattttagggactctactcatgtgttagtgtgcttggtgtggttctgttctgttcatttttattatgaatgttttatttctcttcgtttcattttgggtagcttctgttactactaggtcttcaagttcatctctagaagttccactaggttcttttcaaatatcttcttttgttttttttttatcatgttcatatttttttaaacgcatagaccacatgtacaatagctggttttatgtcctcgcctgctaattccatcatgtttgtcatttctgactgtgttcctattgattgatatttttttttttccctcctggtcataaccacactgagccagactcagtggtgcatgcctgttgtcccagtactcagaaggcttaaggcaggaggattaaaagtacgaacccagcctgggcaaaatagtgaggttctgtctccaaatatataaataaataaccatagtcaatagtttagcccacatcagtactcagccagagacttgaggggagccctcttctgatttttggagctccgtctccatagacagccctctcctctatgatatttaatcctatcaattataaccttccaaactccaacctctgtctcttcaactcagaaaggtcactgggctctgtttgttttcctacctgtctgtactgtgacctggaaaatgcctccagatagtaatatgggaactcatgttgctcatctcctttgtttctctcaagaatcacattccttcactgtgttgtttcttgtccaattattgttgtctcatatattgtgtcaatttttctagttgtttacagtagtagggtaatttctataacagttaatccttcatgtgtagaagtggaagtcctcacagtatgtcctttttgagacggagtctcactctgtcgcccagctggagggcagtggcgtgatctcagctcactgcaacctccacctcccagttcaagtgattctcctgcctcagactcccaagtagctgggattacaggggtgcaccaccatgctgtgttaatttttgtatttttagtagagacagggtttccatgttggccaggctggtcttgaactcctgacctcaagtgatccacccgccacagcctcccaaagtgccgggattataggcatgggccactgtgcctggcctgtccttttaattgtttgttatcatcagtacggtcagagtcaacagtttgtactggatattacatattcctctatagaagcagacatgttggtagttatcattttgattggcataattttggtcaagttatagaactggttattgatatatatgttattataatggtattaaaattaccttttgttgacattacctgcaaatgtttgtagtgttttgttcttagaaattttaaattgaagatgtagctggttattaaattcttgctaactggtatatctgtcagaccttcctattctgactattcttcctttcctcagggctgaatcactagctgcttcttaaaacttttaaacagtatttctttgtcctagaattgcactttattctttcattatctagaaacagtgcatatgtgcacacacacgtacacacacacacacacacacacacaacctttttacttaagaatgtaactatcttctcatctcctacatccaacctgtaaaaggcacataaggctattttaactaaccccttttgagtatccctaatccaaaaatccaaaatccaaaatgctctaaaatctgaaacttttttgagtgccaacatgacactcaaaggaaatgctcattggagaactttggattttgtatttttagattagggatgtttagctgctacatatgatgcaaattttccataatttgaaaaaaatctgaaatctaaaatccctctgtcccaagcattttggataaaggaatatttacctgtagttcaaaagaataaagtgatccaaattatcatatttataattatagtttccaggtttttgggtagtaggttcttgagggtgagcctatttttctattcattttcctacctcatagaggccctatatcacatattctcatttgtcctatcttctgaagccaaagcagtggttcaaacgttaagactctgagtttgtggcaagtattggtttgtttgctggatttcaacttaaataatgctaagtgagaatctggggcacagtagtagtatttagactccgttggatggaaagaaataagaaaagaaaagaaataaaagacaagcaccactttctttccctctaggtgataccaactaaaaaccatacattgttactggtctgggttccttttatttatttctatttacatttgtgagtgttgttttgtatattttggtcaattatagtaataaatttcccctccaaataaagaatgaatgaaattaattttgttctgaaagactggacagttacattatctgtcatttttttcctgccccttcttatacaacgtatctagtgatttgagaattttgaaactgcattcagttttcatgagcataagtatgaaaatatcttaaagtgaagttattgagagctttcactggcaagtataatatacatattgcataattattggctatgacagtgcattgtttatcaacatgtcatctttgctctctcagccctgccctgtgagcttgagccccttataacaacttccattaacactggctcccattgtacaattctttctcaccacgaaactctcactcacttcattctaaccacactgacctctttgtggttccttgggaactgcaggcatactcatactgtgtctttgcacttatattccctctgcttcaagggctcttcctttagatagcaaatctgcatggcttagtaccttgattcattcaggttttgtgtcattgtgagtcttcctcaactattccctatcaaaaataagtgtcttttcccaatcacttcatcattctggactcaaaacatctgccctccttggcctcccaaaatgttgggattacaggggtgagccaatacggctggcctttaaatgcattttcaacttacaatggatttactgggatgtaatccagtaccacaatccatacctttttttttttttttttttttgagacagagtttcactcttgttgcccaggctggagttcaatgaggcaatctcggctcactacaacctccacctcccgggttcaagtgattctcctgctcagcctcccgagtagctgggattacaggcatgcgccaccacgcccagctaattttctatttttagtagagacgggggtttctccatgttggtcaggctggtctccaactcctgacctcaggtgatccgcccacctcagcctcccagagtgctggggttacaggcatgagccactgcaactgacctcatcatccataccttttatcttgcttttaaaatttttattagcacttatttttacttgacaatatgttctttatctcttagtttattgtctgtttcacttgaatagatttcacgtgggcagagaccttatctctaaggtttagaacagtatctggtacataataggtgttcaacaattacttgctagaaggagtcaatgaatgaatgaatgaatgaatgaatgatgttttatttgtatgaggacacctaaactatatacctgatataccttcaaactgaacatataataatataatagaaaatagaaaactctctttgctgtttaagtacagatgctcctcgacttatgatggggtcacatcccagtaaacccattgtaagttgaaaatataagttgaaaatgcatttaaaggccaggctcattggctcacacctgtaatctcagcattttgggaggccaaggaggacagattttttgagtccaggaatttgagaccagcctgggcaacatggtgaaaccctgtctctacaaaaaatacaaaaatttgccaggtgtggtgccatgtacctgtagttccagctacctgggaggctgaggtggcaggatcacttgagtccaggaggtcaaggctgcagtgacccatgatcacaccactgcattgcagccttggtgacagagtaagaccctgtcttaaaaacaaaacaaaacaaaaaaagaaagaaaagaaaaagaaaaaagcatttcatacacccaacctactgatcatcatagcttagcgtagcctaccttaaacatgctcagaacacttttattagcctacagttgggcaaaatcatctaatacaaagcctattttataatatagtgttgaatatctcatgcaatgtgttgaatactgtattgaaaatgaaaaacagaatggtgtatgtttactggaagtatggtttctactgaatgcgtatcgctttcacaccgtcataaagttgaaaaatcctaagttgagccattgtaagtcgggcatcatctgtgcttgtataagttttaaagacaaaattttctaattttaattatagaatttcagttctgtttgactgtaccttgagtgaaggtcacttttttttttttttttttttttaaagaaacaaggtcttactctgttgccctggctctagtgcagtggtgcaatcatagctcactgtaacctcaactcctggggtctagtgatcctcctgcctgagcctcccaaatagctagaactacaggtgcacactaccatgcccaactaatttttttagtttttgtagagatagggtcttgctctgttgcccaggctggtcttgaactccttaactaagggaatcctttgtgccttggcctcccaaagagctgggattacaggaatgagctactatgcctggcccaaagggaaagacctttaggaccaaaacattagtcataaaaattctgtcctttaaaaatctgaacttttatttgttcttcattccataattgagctcagtggctgaaataatgaaaaatcctttgcttttttacttttctttaccttctaaactattctgtagctctttgttagtcttgaaatctcgataagtttttatcaccattatcaactgattattaatattttctgagaacagtgtactgcattgcaggcatctaatgattttcttctttcctcttcctcctcctttgtgtatccataatgtttggactgctagcgttgagcctgttgtgatttttaaagatagaattacacctctctcgacatcctgctgaaacacaagaggacctgttcatagacactgctgtctgtattttctctaggggtattaaaaatgcccatatatggagcataacatactgtggtattaagaggataaacttaatctgcttcattgaggcttattacagattttggagactggggagtctgaagccttgttttcagaaagtgtatcatccttttatggtatttagtttgttttgaactttccattatttccaaattcctgcagaagtatggaaataaacagtattctttctgattatgaccttttgaaagaaataagttgtttttgtttagcaacagcattatcaatttatgccaacacattttttctataaccagtataattacagatagcagtaaggtctggaaataccatctctttgttaactctcattattaaggcaataaaaaatagtgttaaagtttgttttctgagtattgatctgtctgaacttctttgtaactaaaaagaaaatcatacctgtaagtgaaaagctggttgcattcagttgctttgctggccagctgttgttgtagggtaataaggaaccctaagtgagactgctaatcttgtgtagaagttaagagactatgcaagaaactttgcaacattcaagctgcatttccatattgtccaaagaatattcattttggtatttcctcattgcctaatacataacctcctccacttttgtgcacaatctctgtatgtgtgcgtgtgtttgtatatgtgtgtttatatgtatgtgtgtatatttatgtgtctgtgtaggaggtgcttttcaaatgttagctgaaatatacttaatctgtgcatctcttttttttactgaaagcgatcccatcaaatatgatgattgatggaaccaaaattcattgaggccctgctgtttgctaggcatcatgataggtcctaggcgtatgtgttttagatttttgcagatctgcctgggaaatgcttcttttctctcagggaagacaaaccaataattataacacactgtattaacagaattatgtacaagagggttggaggcacaggagaagagcatgtaaattattctcagtggtcgcgaaagttttctgaagaagtatttcttgagatggagtctcatgcagtctcccaggctggagtggagtggtgccatctcagtttactgcatcccccacctcccaggttcaagcaatccacctgtctcagcctcccaggtagctgggactacaggcatgcaccactgtgcctggctaatttttgtatttttagtagagacgaggtttcaccgtgttggccaggctggtcttgaactcctgacctcaagtgatccacttgtctcagcctcccaaagtgctaggatggcaggcacgagcgcccggcctcaaagaggtattttttatgcaaagaagagtagaggtcattttaggcagaggaaacagcatgggcgtaaagcatagtggccggagctatagtgacttcccctgggaactacaggtaattcaacctctgcctcctgggttcaagtgattctcctgcctcagcctcctgagtagctgggattataaccatgtgccaccacgcccggctaattttgtatttttagtagagatggggtttctccatgttggtcaggctggtctggaactcccgacctcaggtgatccgcccgccttggcctcccaaagtgctgagattacaggcgtgagccactgcacccagcgtaatttctgaattctctaagattatttttttaagaagaaagaacccctaaaaatttaatatgcactgtgacccttaaaagaaacagcaggaagtaaaagctgattaatttaatgcatattaaataaatataacatatatgtttaatgtattttccttagtgggagaatacaggctggaactggatggtggagaaagactcaaggataaaattgagaggaaaaaacaaaggataggaatggagaacaaaagatggggaaggggccagacgcggtggctcatgccggtaatcccagcacttcgggaggctgaggtgggcggatcacctgaggtcagcagttggagactagcctggccacgtggcgaaagcccgtctttactaaaaatacaaaacttagctgggtatggcatggtggtgtgcgcctgtaatcccagctactcaggaggctgaggtaggagaatcacttgaacctcggaggcggaggttacagtgagccgagatcgtgccattgcactccagcctgggtgacagagtgaaacagtctcagaaaaaaaaaaaaagaaaagaaaagaaaagatggagagtggagagcacacaccgggtagtgggaggtagagttagcagattttccaaggatttttaaatgatgtgtacttgatgtaggtttccctgccatccagtgctctttaactatagatccccataatcattatttacagtttttgtatgtttgtggttatttttagagactactcatgaataattgaaacaacttatcttgaaaattttcctcaaagataaagcaggaactactagagaaatgctacttcttgactagataaaatcagtcttcacccatattttaattcattacagtgaagctcatacatagttatagtgagccataatcttttgaaattgaattttggcaaagtttgatttttcaaagaggattttctttgtggtgagactattttattgaggatattatccttcttttattatcaaacttttaggtcttctacttccgtctcctgtcatctcagattgctatggcgcagagatgggaatctagctgttggggttgctgtttattcagggaaaaatggcttgtgtttcatctacaggctggtctgtaattgcttgggtaagatgataatggaatctcatagctaaacttaaggcttttttcctgtacagtgcatttcattcttcctagtatttgcttttccttttaccaaaattaatgcatcaaaaggatggtggacgatctgatgaacataatgttcatttaaaaagttgggtagactgaacaatttttgggaaaacgaaaacaagtcaggtagatgaacaattttagaaaaaagtaaaatcttcccttggatgcgtgaaaaaaccctaatttctgtctcctactttcctaccccaccactttctttttttgcatgtatttatttttacaggcatggaagtttttaatgggcattcacttctcttatcttagttcttcctgcttttatctctttttcattttctttttttttttttttttttgagacggagtcttgctctgtcgcccaggctggagtgcagtggcacgatctcggctcactgtaagctccgcctcccaggttcacaccattcttctgcctcagcctcccgagtagctgggactacaggcgcccgccaccatgcccggctaattttttgtatttttagtagagacagggtttcaccgtgttagccaggatggtctcgatctcctgacctcgtgatctgcctgcctcggcctcccaaagtgctgggattacaagcatgagccactgcgcccgccccctctttttcattttcatgtgtttattttcctgacatatacttaccaaattccaagttatagtgcagactgggactatcttactgaacctgacattgtgtccattttaagctagcccagcaggcccttcattttggtctaaggctgtgttcatgaagactgtcccattgtatccccaccaccaatagggatggatgcaaagggtccaggacgttagtcagtgtccccttgccagctcttagctaatagccagtttaatggtgaatccatatctatcgtgagctggaagagctgaagggcacacggtaagggccaaataaaggtttggatgaattgagaactgaacgtgcaaagaaataaagctcataactgaagtccttaagaaatgaagctttttaggcaagcacttctgtccgtaagtctagccaattaagtgtgcagatataagcatgtgtcccaatgtgtgtccatgagtgactactgaagccctcaggtgctctggtgacttcatatgcaagcgtggcctggcaggaactgcctgtgctatgactaatcaggagactttccagggaaaaggatgtcaggcatggggattccacatttagcgtcacttttagtatgtaatgacttccatatcctatttgaaggatccattctcattaggattcttcatgcttgaaatacacccttacaaaagctgaactttctcacgttgactaagaacaagatcatctttgacagatttttgaattgaattggcaaagcaaaattctcctcaagtccaagggtttcattttgctcatgctctttcgttccattgtgttttaaaccaggttgctattatatagagtattttagcagccttgatcttggaaacatcaagaccattgttcctattgttgctgatttagtgttacagctgcttcctctttatgtgatttaatttgaggtttcagcccaccagggggctattggtccccacctatgcagcttgaagagctggctgctgtttctctatggatgttatttccattcctattcatagcgatttttccccttctatattcatctagcaacagcaaggcactgttccaggaacccacactctctacataaggcataacatggaaccatttggatggaaaaattataaattaaaattattctgttcattttaaaatattcatattgtgttgctcaaatgccagtaactggaaaatcatggataatgtcctgtttttataacctctttcagaatgttttaaaatctgtttatgttgttacttagccatctcttttcctggagtggattttgtgataagattttgttaaaaaaaagattgtatgagtccagcgcctaatggcagatataatattaaagatgataccactaatttcagtccactttttaaatagaaaaagatttattccgtgtacagagaatatttataaaattgtacacctctaaaaatagcctatggacatgccagactatttctttggaggataaagctttttattaaatgattaagattaagcaaaggtttattatttctggaagtaggtatttaatttaaactatgaaaacccatatatccataatactactaattttcagatgctaaaaatatcttcagcttttaaaatgtattgagctttttattttttaaaaagctttttaagtgctcttttttctatgtattctgttctcaatgctaagttattgattctttaatttgggaaaactaaaatcttatttctatccttgtattttccatgttgtgtgggtgtgggtgaggatgtgtatgtctcagaaagatagacaggcaggaaaaagtgaaaatgttttcatatggtttagttttttgctgaagtaattatatttcttatgctaaaggaaagaatagtgattggaaatctttttgctgtgtttttttctacctcatggaacatattaagaggagcgaagatctttattttatgcttttttattctgtgagttttaagtccacgttcacataaaagccatgtgttttatttgttgtctctcttggctaggaatatttaaatgtatttttgaaactcttctgttctgtcaactaaaggtaatttaaaattataattttaagacactttctagaaacttatactttggttcaggctaaagtcttcagtttgtgtgcctgtgtgtgtgtgttgaggttcttcagaagcaacaaaccacttgagcgtgagcaaatttcacaggctcccttcattgtttgttttagcctcgttaatcatttggcctttgaaaataggctgatcatttcattgaatatggattgagaaaagttctgtgtgccatgaaaggcctgaatggctcttgctgactctgttttattcattttaaataacatgagggggatcccaaagtatttcctctggacttttgaagcattatcattgcagggtatgatatttgaagtcaggattctttataacaataataacgacaagaatatatatacattttcctaaagtctgatttgtggaaaatagaaagcaaactgtcagtaaacaggttttccaacacaaacactcagtttaggcagcaaccaacttttttgaatgcagcaacaaaatgaatactatttttaattgaataatgaagacagactagaatagttgctatgagaaaaatggataccttataattaataatatgtgagctaaaccttaactacacttgacatttttccttaggttggtgccatactgattaatgagttaactgctgatggtgcctattctgtggagtgactgtttcagttccagggcttagagtgttcaataaaataggtattctctgaggtgggactgaggctttagtcttgatcaaagtgctttgggggaagcacagttgaactgattggctgtgaatgttaatcacttcataggacacactgataatttacagcattgttgtaactctctggtgttcgtaaaatgaacttaataacccactggcaccatgggataagctgctttttctctgcaattgaatacccagactgcctgaataatagtgttgagaaatactgcattaaaaacagtgagcagctgtatgatgaaggaaacagctctgccacagatttgttaattatctcttttgattcacagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggtaaggaaaagcaccctatttgcatgctaacatagacactaaccagtccagacagtgtggcagcctcagtatcatcacatcagcttcatttaaaactccttcacattttttttttgtagtcccgcatttccaagaatgaatcaagactttcaaatccccttctttggcaggcaacacttttttacttcctcatcattaattaacattgcccaaatttttcaatacttgccaccttgccacagttctttgtttcttgtttgtagtccttcagtcttccagcacataaatttgcctcagttcctccattttgaccgctcgtctgattcagaactgctaatgtgttgcattaatttcgcaacccacagtcaatattgtgttatccaaactactgttagccatatcagaaaagggactgtgcttgaagctcgaggatgaattttcaatttcatcccttcatctggagatacataggggtgaagttgaatcagagggacacagagcaaggtactcttccacttgatttgcacatgcattactgtggcacctgtattcccattgtaaggcccatccctgaatacatgacattttctttcagagaatttccttccttgtttttcacttatcaacataatggtaatcactgtgaacaaaggtgattctgagatccctgattttgtttttatacttttccacagatcgggatgcttacccttaagtagctgtgtcaaactaggcaaatgggcatatgtccaggtaactgtggtacctgaaggcaaatgacacagtaaatatgagcaaagaatatggacaggagagcaaccatataaatgaagaagtacttgctaggatccatgactactatttgagaaataaaataattactttagacccatagttatggaaataaaatctgattagtgcaattgcaaagtcatgtgtaaagcatgaaaatgaataacttttatttttttcaagtgtgttctttgcagtatgtttgtgcagaaaaataacatcccaaaaagctaaaagcaaccactgctgctgaaatttaatgcaaatgctaatgaatagctaaacatttaaaagattatttcgctgatttgattttaagactatacttgttgaggtttttgttgaatggcttccttaatatcaacaacctatttcagaaattctgaaaacagagttaataatttggctgctaattataaatacataatgagggagtttagcaattttaattttattatttacatttttctagctagctctttctagtaagggtatatgatttatatgttaagtttagtgctttagacagtgtgggatgattatgatttgctatttaaaaataagttgcaggcatgtcaacttttacttaacactttgactcaacacttgataaagcaaagtgattctctgtaaaaaaaaaaaaaaaaaaaaaatcaaatatgctaagagctgtgacagtcttgctgtgtttgcagtaaatgtgaggcatacatcgtgaagaccaggagatatactagacgtgtggagggtaggaagggaaacaggccccatcaatataaggtttatgataacagccactttttttggattggaaaagatctgatcagggatccagggacccacaagagatagagtcaggtaagttcaaaaaggaagaagcacaaggaagaaaaatcttgtgttggctctgaggtaactaaccaaatactccttggaataaattcagcattttaattgattgcaagattgcagcagctaatactgtgtgtatagcaaatcctagtgctcagcacctgaagtagtgccagacttggggagcgtctaaaaatcaacaaaagatctgaaatataactttatactttgcctggaaaacaccagatgtttagttcctagatcgtagttggagtgataacaagttttgatggtcatgacattatattttttaaaatcctctgaagtatgtatcatgttggcctttcctcctacattgtcatcttgaggcaacaatcttgttatatctgtctgtggatctatcccacccagtagtggctcaataaatgagtgaatatgagaatgaatacaggaagagctgcccaggctcagtggctcacacctgtaatcccagccctttgggaggccgaggcaggtggatcacttgaggtcaggagtttgagaccagcctggcccacatggtgaaaccccgtctctagtaaaaacacagaaattagctgggtggagtgataggtgcctgtaatcccagctactcaggaggctgaggcaggagaatcgcttgagcccaagaggcagaggttacagtgagccaagattgtgccactgcactccagcctgggtgacaaagcaagattatctcaaaaaaaaaaaaaaaaaaaaaggaagagccttcttcataaaataaattatagagcccacactgtagtcttgaactttgaaatcctaacccctggccagaagaggcagcaaaagatgatgaagtaaatgagcttcaagggtgagaattgttccccacagaaagccacccactactctgcactttatgtgcaggaggtaatccaggctgtgataccacacccagggagaaagccatccaaaagaaacagagcaaaaggaaacaaagatatgcaagaatcaaaggtctacaccatctcaaagtaagaggttttaaactcttcctttgtttcctggaccagaccttcacaccttgctgtttcttctcatcctcctctgcatggcagagcccagaacactcaggattccacaaacacatcgtatgtaacagaaaaggtgactgagccccagaaggcttacatggcttcccagtgtcaaaacgggcagtagggaagggagcccaaatctggtgctcctcagtcctgtgcacagcaataccttgtacatttccattttcctctcactaggcttagaccactctacagaaattacttgacttatctcaagggtactgaacagagttcaccaataagaaaaaacagaagatgaaaacagaaaaaaataacagcaaatgaaggtggtgattttttaaactatagggattgaaggaatccactcttgaaataactaccctgatgctttaaaaccttcagggcaaggatttcttgagaattttattgggaagacagccttcttgtgtttttagaagatgcttcacacaacagactttaattagagagtacttggctggtttgttttccttcctcttcattctgttcacttcttattcacctgactctcagattttttaaaaacaacttttaccaacttaaaagaaaaaaaaccaaacagtttaaagggaaagttatataaaggaaagcaccaaagtttttatcattatttaaaagtatgccggggaaagatacatctattgagaatacattttattcaatctccataggaatagaggatgcacattacacttaacacaggatcacttttaaggtttcttcaagagtctagcattgtgtgtggcactttatatagcaaatactgaatacatgtgtactgaataaaaggaagggaaggagaactctttatcactcataggcagacaagtagtgaagtgtgtgtttgggacatctgcaaactttatttttagtatcactgcccttaaaaaacaatataggattcatttgaattatgatatagctgacaaaagatatctcaaacatatatattgtgaaaaaaacactctggaattgaagaaatatacctatgagcttatacaatgctgtagtaaacttgcatatgataatagaatcaatagataaaacaataaacatgctttatgtcaccttaaagtccctattgcctaaaggataagaataagcccttgaggacattcagggtacttatttttttctattacattcttattcatttgtcccttgagtagtgccctaatgatatctcctctatatctttttttttttttaccatttcatactcctgaaatgtttacattacctttttctcatgatatacttaccatatgatgacagttggtagtaatgtgttaatcagacatactaatatttgctactacatgtgttggctaatatatcgcccctgtagtggcaaataagatgtattttccctgtgtttgctttcctgttgatattgctaatgtaataacctttgcatattcctctttaatgaactctgaccttgtagaaagtgaagcggtttatgaatttgattactcttaaaactacattgcttagttttgtcctcctagtgataggtagcctacagctaaagtattaattcagactgaaaataatacatgtgaacccaacaaggttcacatgagaccagtgatagtggtataatggctgctgctaatgaggcacctgaaatcactgctaactgataaaatcagtacaatttatcaagtgcttattgtttgcaagaaactgagtgctttacatgtgtgatctgtttttcctcttagaacaggctagctatatagatattattatcctcaattttcttttgcccacttttttgagatggggttttgctttgttgcccaggctggagtgctgtggctatttataggtgtgatcatagcgctctacagccttgaactcctgggctcaagtgatcctcctgccttagctgggactacaaacatacaccactgtgcctggctgttatttttgttttgttaattgagaagccatgggttcgaaaggttagataactggctaaaccgcatagccagttagccgctgaactggtttctaatctattctaattcgcaaatgctttctactctactgcatcttcaaggaagccttcccaaactcttcccacatatgttctgtgcttcatagtacccctgtacaacaggtctctgtctctttgggcactcataatggtgcatcatgattacttatttatgtagaaatccaacatgactgttatcataagggagatgttgtcttatccatctttgtatatcagtgcctgtgataacacacacttcatacacctaataaatgtttactgaatgatgtgatagctcaaagtttagtttattaactgttccttgacttcatgcctcatgtactgaagtaccttcatatctgctgagcatccagttttggaagagtttgggaacggttgtcatatatgtttctcatgagtcacatttctgtgaagatgtactggatggttagggattcatctaagggatgcgttatgtttatttgcccagctaaaatactatagcgatagatagtatctttagggctgtctagaacaaatgagcttattgtatgattatcgaatttgtagatgatccaggctcttaacttctttctcctcttcctgcttgttaacttacactgctttttaaaatctccactagagaggatacattaaaatcagacagtttgtcttggttttagtttcgtgaattggctgatagggaaaagatgttaaagctcttgggcagtaaggaaaagagtaagtatctggattttatgtatttaagacacatgcatgcatatgttcattgcagcactatgcacaatcacaaagacatggagtcaacttaaatgcccatccacagtagactggataaagacagtgtggtatgtgtacaccatggaatactgtgcagccataaaaaagaacaagatcatgtcctttgcaggaacatagatggaactagaggccattatccttagcaaactaacgcaggaatagaaaaccgaataccacatgttctcacttataagtgggagctaaataatgagaacatgtggacagatagaggggaacaacagatactggggcctgcttgagggagatcagggggaggtgggagaggttcagaaaaagaaaatatcggctgggcgcagtggctcacgcctgtaatcccagcacttcgggaggccgaggcgggtggatcacgaggtcaggagatcgagaccatcctggctaacacagtgaaaccccatctctactaaaaatacaaaaaattagccgggtgtggtggcgggtgcctgtagtctcagctactctggaggctgaggcaggagaatggcgtgaacctgggaggtggagcttgcagtgagctgagatcgcaccaccgcactccagcctgggcaaaagagcaagactccgtctcaaaaaaaaaaaagaaaagaaaaacaaaaaaaaaacatcaagtactacgcttagtacctggatgactaaataatctgtacaccaaacccccaagtcataagtttacatgtataacaagcctgcacatgtacccctgagcctaaaataaaagttaaaatgtttattttaaaaagttattctggtcctccctctgtcatgaatagttcaaagtaacttatctccctttaagagacttgcgtgtctcaaaattgtatgagaattttagtgcattacttacaacctgcgccagagagggcaaactggttaatctagattgcaagtgcttattaaggactattcctatattcaaattataataaaacaagttatatatttttaaacatattactttgtaaaatattgccaaacaacattgacactaacattcacattgatattatgctacattttatttagcttgaattaaaatatatagtattgctcaagatttatagctagtatacttatggtacatgtcatcataaggttaattacaaatagtgatattttaaatatctcttctgtttttggtttggaaatcttttaatcaccgtaacaaatcagcttcctgctaccctagatttttgtatgtttacttctacttcaatgaccttatattctaacctaattctgtatttagtgaaataaattcatctgctgaaagacagtagatacctgtcaaggacttttgttgcatggtaatttatgaacattaataatatgtttgcctttgccgagttttaaaaaatgcctcatagtttcaaaataatagcaaactcaatacatgctgtgcttatgtttcatcaaagcaatacagattttccaaactgaactcagcagttcaagctgtgtctttaaacatttcttttccttagggtttatactttctggaataatagaataatatgtaaatatattctctactgttgtatacaaaatatttttccccttttgatgaataaaaagacatgctagattacttattttcagcaaggaaatggaaaggaaaaatcttttatttcaaccatccacctgtagcttttgagacatgtcagtatgtggtttgatctaactgttggcactgttttttgccatttataatcatcagtgctctatttgattcttaccctggcacttgcgaataaattttaagaggtcagtgaaacacctaaaactagaaacagaagtttgtgtctttctgaatattaaagagagaaaacttttatcaaatattaaaagggctcatatacattttctttttaagtttatcaggcttcattgggaacctaattctgagagctgggaacagcctctctggaagggaggatgtggatgaaaggaatgtcctttcttgcctgccaaaggatctaatactgataaaagatgaaattgaaatgctacttccccttagcaaaattataggctctacctaacattctaactcttcaacttctctgctagtcctgggtttgagcagcaggaagctttagttaggcccttccactaaaaaaaaaaaagacttgcatctctgcccatacctgggtctcggcctctttgttctgtgatactacttgcttgtgcccttgtccaggcctcagcccctaattccagctctgcccaagaagccaaagcttttcttgatctcaactactcctcagaaaaatttaccgagcttgttgcttcctactactgagcctttgtttgtaatgttaagtctgggtgagtaagcctcatgattacatgtagaccgaaggaccccaaaataaatgaacttataaatagactttatttcagaacagattgcactttgttgctgctgaatgttattttatccttattgtgccaggtgtattttctgggtaaatgtttctcatgttgaaaatactgggtacctctgtcttcctgaggaacacaagaacatgcctagatcatacttaaaaattctctttatatggccatcaataatttatacagagacctatcttatgtgcttcactggtattctcagttccagtgtctatattatgagaaagcaggcatgagagaataaatctagtgtgagaatataaacagccaaatcattcatgtttgtcctgaaatgctttaatccacattgtggtataaacttctgaacttcccaaacttagataaatttacaagaataaaacaaccccattaaaaactgggcaaaaaacatgaacagaaacttttcagaagacaacgtacatgtggccaaccatcatatgaaaaaaaaaactcaacatcaccgatcattagagaaatacaaatcaaaaccacaatgaaataccatctcacaccagtcagaagggctattattaaaaagtcaaaaaataacagatgctggcgagggtacggagaaaaaggaatgcttatacactgtggatggaagtgtaaattagttcaaccattgtggaagactttgtggagatttctcaaagacctgaagacagaaataccatttgtcctagcaatcccattactgggtacatacccaaaggaatataaatcattctgttataaagtcacatgcgtgggtatgttcataggagcagtattcacaatagcagagacatggaatcaacctaaatgcccatcagtgatagactagatcaagaaatgtggtacacagactatgcaaccataaaaaaagaacgaaatcatgtcctttgcagggacatggatggagctggaagccattatcctcagcaaactaacacacaaacagaaaaccaaataccacatgttcttgcttataagtgggagctgaatggtgagaacacgtggacacatggcggggaacaacacacactggggcctgtcactggggccatgtggggtgggaggagggagagcatcaggaagaataactaatggatgctgggtaatgaaataatctgtacaacaaacccccatgacacaagtttacctatgtctcagggctacccatgtacccctgaacttaaacagaagttaaaaacaaaacaacaaaacttctgaacttctcaaccactgtcatcattttttccctcttgccattgacccaaattattgaatattgtttataaaatgcagtgacacacggatatttgttcccaaaagagacggttaattttcgtgagaggaaaagaacatagggataccatggttgtcaagatgatgagtgaaaaggccttagcaaatcctttataaataaactgatgtttggccaggtgcagtgcctcacacctgtaattccaggtgtttgggaggccaagacaggaggattgcttgaggtcaggagtttgagaccagcctgttcaatacagtgagatccgtctctgcaaaaagttttttacaattagcttggtatggtggcacacatctgtagtcccagctactcaggaggctgaggccagattatcacttggacccaggagttcaagactgtggtgagctatgatcatataactgcaccctggcctgagcattgagaccctgtatcttgagaagagaagaggaggggaggggaggggaggggagggaagagggaagactgtagtgagctatgatcatataactgcactctggtctgagcattgagacactgtatcgagaggggaggggaggggaggggagggggaacattataatcatagttgaatatctatcctgggtcatgtctctctctatgtatattttttgaggaaaaatactcttttaaagtaaatataaagatctctctcactctaacatacttgaaaaacataaaaatttacatatttcaactgacacacatctattccttcttcatcttttagtattctagtgtacacttccgtttatatagaagagcattagatatgtatatggtttaatttacatcttaaaaggcatttcacattgccagtcccctgaatccttaatttcacccggagtagctgagaaggctttcatgtcacctgtcaaaattagtgcagttcaaactccataatacaccagctgtgggctttatcttcctcattaatttaggaagtcagttatgctcaaaccattgagaaaagctgcctttgacattccttcagaagcacagagaatggctaacacataaggcaatccacgtagtttcctttacacttttctattctacgatcctctcggtattgacttctttgctttaatagcctatgaaaggctaccttaggcacttgctaattcagcacttagtaaaatgaaatcctcatattttacatcaggtaggtaatggaattttcaggtgattcatgatctagaacagacgggggtaatgaagttaatggttcatagaatagttgagggacattctgcatatttgtcagaaagcaaagtccgttcccttcatctgcttctgtttatttctaagatactaaattgttgcttttaggtctgatgtacatctgttctctacatcttcctgaccctaccacagaaatgctccacttgaaaatgttaagctttcaaaatttaagttcaaaaattctttaatatcatttaacagtaaataatgattatgtcctaagttggaaacataaggattattgttattatagactcctactgctcagaactctttgatttgcatatgttgtatcagaactatcgaatattaaatatgggcacaatccatgtttaataaatcacttttaggatcagaggatgctgcatgtaggccagagaaaatcaaactgattgtttagcataatcctgaaagatccccaattattcattagtttgaggggggaaatggtttctgtttataacatgtattattgtgtgtttttaaaaactgttgcagaaagtttactatcaatataacattgattagagaaaatactgtcattaagtctgtttctaatatatggtcataaaaaagtagtcttcatagtttaatgttaaaatatttttaaaagcatactctgtatcagcttttattttgcaatgtcatgtggaatatcaggctaccttctgattggtggaaatttcagacattaatcttttagttaagtggctcctacattttcagtctttatttttcctacctcagcagactctttttatttttttgttgttgtttctatattcttccattattgcgtttgtattggtttatctgttgtaacaaagtaccacaaactgggtattttgggaactctgagagagaatttgttctgttcttgtcccgcagcttctaatggttactgacaatacttggcattccttggcttatagacatatcactccaatttttgtctcagtcttcacctggcattctttcctctgcctctgtttccagatgtcctcatcttatacaccagtcattggattagggtccaccttaattcattatgacctcattttaacttgattatatctattaagaccctgtttccaagtaatgtcacattcacagctactgggggttaggacttacatttacatctttttaggggacacagttcaactcataacagcctccttttgtagtaaatagaaattctttagtatgacattttaattactttgttgtttcttttactatatatattttaagtcatttttatagtggttaccatagggattacaattaatattctaatttataacactcttattttgatcaatattaacttaattataataacatatgaaaactttgctcctatgtagttcccttcccaccccacttctttttgttgttactgtcataaacattacatatatatgcagtgtatgctcagtagcacagacttataattagcactttgtgcagttgtcttttaaatcagataatataaaaacaagagttacaaacaaaaaccacaattatactgtcttttatgtttacatatgcagttacatttactgctgctctttatttcttcctgtggattggagagtcctttcatttcagcctgaagggttccatttagcatttcttgagaggcagatttgctaacaactaattcctcttggttttcatttatctggaaatgacttaatttcgtcttcatttttgaagagcagcttctctggatacagaattcctggttggcagtctttttctttcagcattttatatcatctcacttccctctcttccatatggtttctttggagaaaccaaatgttaatcttactgaggatcccttatctataagttgctgatctcttgctgctgtcaggattcgctttttgtctttgactttcaactgtttgattatgatgtgtctgggtgtagatctctttgagtctatcctacttgaagtttctagagcttttaggatgtgttgattaatgttcttttttgttctgggtttttttttttgttttttttttggaccagggtctcactgtgtcacccaggctagagtgcagtggtgcagtcatggctcactgcatccttgacttcctgggctcaagcacttctctcatgtcagcatcccaagcagctggggctacaggtgtgtgccaccacacccagctagtttctgtattttttatagagacagagtctcactgtgttttccaggttggtcttgaataactgggctcaagtgatcctcccgccttggcctcccaaagtgctgggattacaggtgtgagccaccgcacccagccaattagtgctgtttttcaaattagagaggttttggccactatttgttcaaatattctttctgctcctttctttcctttcctagaactcccattatgtgtttgttggtgtgcttgatggtatctaaggctctgttaattttttctttctattccccccatcaagtcatctgaattgacctgtcttcaagtttgctgattgtttcttctgcttgttcagatctcttgcagagcccttctagtaatttttaaattttagttcttatacattctatatcagaatttctatatggttcttttttattatttctgtctcattattggtactctatttggtgagacatcattctcttgattttccttaattcttgggacatggttttctttagttttttgatcatatttaaagtgctgatttaaagtctttgtccagtaaagtctaatatctgggctttctcagggacagtttctattgtctccttttttcctgtgcacaaaccatattttcttgtttgtttggagggttttcttatggtttatgatttttgttattgaatactggacatttgaataatataacgtggcagctctggaaatcggattcttctcactccctacagtttgttgttgttatttggtgacttttctgaattatagttcagacctttgaacaatgcacggcttagaggtaccccctcagtgcagtcaaaaatccatgtataacttttgactcctccaaaagtttactaatagcctactgttgataggaagcctcaccattaacataaacaatcaattaatgcacgtgtgttatgtgtattatatactgtattcttacaaccaagtaagctagaggaaagaaaatgttattaagaaaatcataagaagagaaaatatatttactattcattaagtggaagtggatcatcataaaggtcatcatcctcatcatcttcatactgaataggctgaggaggaggaagaagaggagctgttgattttgcagtctcaggggtggtaaagacaaaagaatatctatgtataagtgaatgcacacagtacaaacccgtgtttttaagggtccactgtaattctgtaaagtctgtattctttgtcatgtgtgaccagtgaaatctctacccacttagcttaatagtcagctaatgattggacagagatttccttaaatgcctggaactagtaagtctctcagtttttgcagggaggcctgattgtatatgttggagcttgcctggaatgctccatcaggtagcttataactccacctttgcctttacttcctgtttctgccaagtatcaggtttagccagaggtgagagtttagcacgttctcagatatttggttctcagcatgtgcataacctaaacacacacccagccctatgcatacatggaaccttctatattctaggaaatatgtcagtgttttttaggctttgtatggatatcacattccctgccttttttttttttttaagctttttgatttgcttattgtttgtcccagctgttatcacagcctgaggcagccctgatgttaaacaattgcagctgattatttttgacaaatgtctttgggcaaaagactgttctcactgggttagtgccaggtcaggttaaataagcaagctgtgtgagtggagccttccttggaaccactagtgaagtccaataatgatagtttttctgggaatggggctttgaagaagttacaactctattatgccccctcaagtggcttccaggctgctggttttcatgattgaaggctgttggttttcaaggctaccatggaactagaaagtgggaggtgagattaggataggccaaacacaccacatagctccatgttcttaccaagatttatttgttttttaatgaacaccacccagattgctgcaaacctttagttaatttccagagttctgaaaaagttgactgacaatttttgtcagtgttctcattgtttttatgaaggagaggattttcagtctttactccaccattcctgctgaggtcaataaaaatttatgcctgaaaaggggctgccttgtatctatcagaccatcaatatgtgaagttgaatcacttttcttgcttaatttttgtgctgcatgtcaaaggtgcatcaatcacttatggtgctgtcttcctcataaagcttttgaggaagaactcatgtcattagcaggttattgacagcaaatgatcactattaattgagtcaccatcacagaaagcatggagacttacagactaaaatgtatacttctttagatacttctggctttggataccacacaagaaataatatggcatagatagactgaatcttgcctatgatggttaattgcttctttctgttttttgttttgttttgttttgttttttgagaccaagtctcgctctgtcacccaggctgagtgcaatggcatgatctcagctcactgcaacctctgcctcccagattcaaatgtttctcctgcctcagcctcccgagtagctgggactacaggcacgtgccaccacacccggctaatttttgcatttttagtagagacggggtttcactttgttggccaggctggtctctaactcctgacctcgtgatctgcctgccttggcctcccaaagtgctgggattacaggcatgagcccaccatgcacggcctctctccctgttaaaaactgatacttttattaagaaccaaatcaaatattatgttgttatttctattctgatagataattgagttccacaattactgtctttcatgatgtcaaagctgctgttggtctagattcactaaagaagctttgttttcttgatagatgatgtccccttcactatgccgtgtcacaccatcagcatagtcttccaaaagctgtgcacatcaggtgattggacatttgttgatcggaaagatatttgcttttgatgctgcattgctaaattaaaaagataatcaaacttaaaattaatagatataaactctagaatttgcaacagatcactagaaaaatattgatatttcagggataatcaatttcaaaacttaaagagtcattttgaaatctgcagtacattgtgttactgtcatagaagtaacagattttagaatataacaattttattactaacatatttgttatagctttattattttattctagtatccttcaaatcaaatgggtcattattgtattgaagtgtttacagaagtagaagatttaaatctgaatcagttttatcattaatctggcaaattagttgaatcgtgatcattccattcacatgtaagtcatctgaaaagggagcaccattttgaagagtttaagctgaatgatgtagattttaaattttccacttgctctctaattccaggccttccaaaatatttttaaactcattttacttgatgtgaccttgaattaaaaaaaataacgtgaaaaaactgttgttccattttattatctgatatttggtgtgaaataatcatctcaacacttgctttgacagtggcatatcatttctataatcctaagtcagagaggcctgagacaccaagggcttctgtttctgtagtgagcctagagactcacttgaattgagtcctccattcaacacctgagaaagaaacattcttttggatagaatggccttcctcacttgcaagtgtttttcatgctgtaaataatacagtgtaaagtgaaatttacagaaaatcatatcacaagatctctctattgccaaaaatggattgttctgcatactcttcttgttccacactggtggccctgtagaaggactggagatcattttggtggccaagttcatgaggcctcagacacagcccactggcagtcactcttatcacccaggcttgagacactcttagctcttccttagcctttagttaagtttctcaaggcaccagctattcttcttttagacactcagttttatccgtggaagcctatcagtttctttttatgtttcaacttcccaagtccttcagattttttgaagaaagtttgaaacagaaagcaggataaacaacttattttcatttctcttttgctcttccaccagcctagcccacgttcctaagggaatgaacagcccatctctgttaattccctcagtttcaggcacatttcctgtttggaacgtgggtcatcagtgaattaatccatagcccttggaattatgaagcttatggacctcccttctcttaggaaagcatgcttgattttagaactcagagaccgtgaaaggagaactgagcattgttgattgtttgctgtcagggccagtctttgacatgggcctggatgttctgctgatttttgtggagcactggacagattttcacatttctatgggttttgatgttttcacatatcaactgggcatattagcagttaccctatacaaagaatattagataacatatcactagtgctttctgggatgctatataaattgaagactttaggccgaggcaggagaattgcttgaacccgggaggcagaggttgcagtgagccgagatcgcgtcattactctccagcctgggcaataagagcgaaactccgtctcaaaaaaaaaaaaaagactttaaataatggagtatcattatttagcttataatagagtaacattggtagaacaatgaattgatatatgtagaatgcttagaatagtgtctggcacataaaaggtgctcaagagttatcagctataattattatcattgttactatactgagattttggaattttaccttaaaaacaatgtatcacatatgtaaatataaaggtatcttttctatataaaggtatcttttgggtcacatattcctaatgtttattttctcatgattgatagggtaagccaaagtcaaaagtacctgtggggaaggagaaagctagccagtgagcggggagtgaagtaggacccatggggaaatgtgagactttccaaaggctgtggagggaaaggtggctctcagtgccagtcactgtgaacagcagtagaggcatgccagtgttcactggggtctctgcttcagctgctgccatcctgccaggtgatccaacataggatcataagcaacatgggtcatcttttgtttgtttgtttgagacagggccttgctctgtcacccaggctggggtgcagtggtgtgatctcggcccactgcaacctctgcctctcgggttcaagtgatcctcccacctcagcctcccaagtagctgggactacaggcatgcaccaccatgcccagctaatttttgtatttttaggaaagtcatggtctccctatgatgcccaggctagtctcgaactcctgggctcaagtgatctgctcacctcagcctcccaaagtgctgggattataggcgtgagccaccctgcctggcctgggtcatcatttctgactagcaatgactataaacaatttttaagaaattattgttgtagacgatatataactgtgaagtattatatagaaaacgcttacattagggaaaacgtgaagaggataaaacaaagaggccccaaaatatggtggcttatagaagtttacttctctctttcacagtccacagatgggtggtccaagattctctagaggatttgctgtcttcagtgtgtgccttccctctctaggtctaagatggctcttctttgtcctgccgtcatgttagcatcccaggctgcagaagcagaaaagacaatggaaagacatggcatgcatttcttctactggcctgacccaaaagtagcagatctcttctagtcatattaaatccaagcttttggctttgcccaaactttgttatttgaccatatgagcaattaatctccagcttggtggtcagaggtgtagttaaaatttgggaattttattactgaagaagagagaagggatattagggcaaccagcaatctttgccacaacttcacattggatagggaaaatgaaaagaacattgtgtttcttttgtcttgtgatagtgattaatatctagctattctttattctcaggctcactttaatatttgagaaatcagagttatgctctacaaataatatataacattgatatcgtaaggtttctatttttctggattttgttttctccttgaaaggctgttatcgagttgatggtgtggtttaccatcagttgcatcttagaaataaaatatttgggccaggtgcagtgactcgtgcttgtaatcccagcactttgggagtccgaggctgacagattgcttgagctcaggagttcgaaaccagactgggcaacatagcaagacccagtctctgcaaaaaaaaaaaaaattagctgggcatggttgtatgctcctgtagtaccccctactcaggaggctgaggtgaaagaatcacttgagcccaggaggcagaggttgcagtcaactgagatctcaacactgcactccagcctgggtgacagaggcagaccctatctcaaaaaaaaaaaaaaaaaaaaaaaggaaagaaacaaataagatatttggaccatgactccaaaacaagaagactgtttttagcaatgctttaatatagatatttatcttatgtccctgtatctacctcagaagttccatttgtttgtaattggagctgattgggaggaaaaataccaaattagagccagatcttttggccatccggctaactacgaacccactgactgaccagttaatctctgccgtctccaggtgatagatatccttgccttgtagatatcaatgctgcaattactcagattcagtttatgttccaaattgcctaatttcacatctagactgtgcttttcttgtgctttcattttcgaacaagtttgcttggtatttagtagtcccttttttttgaaactgtgtctgtgatatgccctgatacataattgatgttactaataattctatttgattttactacattaggtaactacatacatagtacatatgcttcatgtatatgcttattatatatttcattcgatgtctttgcatacataacatctattcaataacatcagggcatttcttctctaaggtgtgtgaatataaagtgatatttaagcaacacgtattattttcaaagtaaaaatagtctctttgacttagttatttcataaaatgagcactgattctacagatattcaattatacatttgaaaaaaatggctaagcatggacaaaatgaatgcttcccacggatgttaataattttaagatacaaagctttcaaagaatatttgactgaaacccaaaatatctaagagaatttaatttactttttgatttgttccctaaagggccaggattcttggcattgctgtactttatggcactcttactaggttattatcactcaaagcccattgttttcattaaggttcacctttgatgtaatatattctttgggttttgacaaatgtataatgacacgtacccaccgttatagtatcatactgaatagtttgactgctctaaaaccccacattattccacctatttacccctcccttcttctagccccagacaacccctgctctttttactgtctccatagtttcgccttttccagaatgtcatataattgcaatcatacccttttcagattagcttctttctcttagtaatatcatttaaggcttttctatgcctttttctggcctcagaactcatttcttttagtgctgaataatattccattgtctgaatgtatcacaacttatcactatagtagaattctcattttgaagacatttatgattaaatattattaaaatgtattctttgttaagtgaagtgatgtttacaaagggggtaaatactgtaaaacaagaaaaagttcctgaaattgaattctgtgactgaaattagaataaatgaatccatttgttccttcatttatgatgactggaccgtagctccttgactttcatctagatcttaagctttgccaaccactgcctcctccccaatttttaaaaaactttttattgtggtataacataaataccataaagcgcaatgatcttaagtgcacaatgagcctttacaaatgtgcacttggatgtgactatcacctgatcaagaaatagagcatttctagaatctcatgtgattgtctcatgttccttccagttcacacatccaagagacctctattctgaattggaaaatttgatcactgttaattttgcttgttctcgaatttcatgtaaatggattcatacagtatgtactcttttgaatttgatttattttgcccaacagaatgtccatgagcgtcacgatgttgttgcatatttcaataatctgtttttattttattgctgtgaagtgttgttttataaatatatcacagttcacccattctcctgttaaatattaggttaatttccagatttcaactattgtgagtaaagcttctgagaacattctgtacatatcttttggcagacataatacactcatttctcttgaatattcctgagtggaattgctgggtcagagtgggcatatgtttggctttaataaaattgcccatcatgtataaaagttgctgctattctattaaatagattttggataggaagtagtaaagacccttaaagaaatgacctagtgtaattaatatccctcttgaaaaggggaaatatttgggatttgttgcaggttgtttttttcccatgagtagtgaacataaagcttattcaagagaatgaggtaatttggaatataaagattttatttatgttagatatatgatagcagattaaataattgggccacatattctattagaatacactttggtacagtttagttaaattgataataaaaggcacaaattgtatataaggaggacattgttcttaacatctgaagaccttggttctaactctaattttagcactatgtaaccatgtgaacttaggcaaattatataacccctttaggtctttgtctttggaagtagaagtgatgagagaagagtttggtctatattatctcctaggttccttccagtttcctcattctatgatttttaaaaaataatttatataggctgggcatggtgcttcatgcctgtcctgtaatcccagcaatttgggaagccaaggtgggcggatcccttgagcacaggagtttgagaccagcctgagcaacccagcaaaatcccatctctacaaaaaatacaaagattagctggacgtggtgatgcacatgtgtagtcccagctattctgaagactgaggcaggaagatcacttgagcccaggaggcggaggctgcagtgagctggaattgctccactgcactccagcctgagcaacagagtgagactccgtctcaaaatattaatgataataataataatcattatttatgtaaagttaatgttttgttaatatctaattaatgaattaatctaatttattaaatttcactgacttaagagaaaataagcaattgtagactcaaagtcataggactgaatctaaaatttgatactactcaaattttgatatagggaatactaaactaaaattgtatgctttttaaaatgaaatattaaaaactttgctggcaacttctttggttttgtaacgtatcacagatgtgccttcccagctactatgtagtcagaatcctaaaggacattccacataaaatgttgcagaggttccgctttggagggttttgtaaagtcagcttgaaactgattcaaccaatgagtagctcttcagatcctacactgattcagagcttcacatgtggcgggtgtttttcttaagttattagtaagtgccacagtgcaggaaaaagggcaatcagctgtttctgttatgattaaaggtagacgtttcctttcacagtcttgccatttcaaaatttggttcttttattacatccagatgagactgaaggaggctatttgatacttctgcttactgcagaaatatataattatgactaataacgcaaaatactatgtgaaaaatataaacaggaaacagatgttaggtgagacatacagatgctgtaaagttgagctgtatttgagatgctataaacgagctatatttgagactaacagattttcatactctctttggactacaagctaataatttattactgagtgatgaaatacagtatattttctttgaagtggcctgtaggaatttttcatttgcaaattttaattttcagtgaaaaattaaaatgaaattaatcatcatcctgtaaatggtaacaagaatggtaaaatgagtataaaatggctagtgaatgtgggattgctttgttgttgagaatatagagtttttgtttgttggggcactagcatagtattagtacactatcctccactcttccactgatttgcctcattatgtgacctccttgcatcttatttatcttaaaaaggattttaattttaggctcctataatttagtcatattcataattagtctttcataattgcaaatgatgaaaaattacttttggttaactgatcattaaaaaattctcctgtataaaaagtaagagtgtaatcttcaagtttaaaatgcagaaatgtaagtataaacaatctagagttgaggtttccctagcggcatataccaggtcattgaaaaagtcaaaatgaaaaattgtgtgtctgtgtatattgaaactatggcttgtttcacttgagcacattgactcttggtaaaattagctgttattcaactcaattcaacaaaaagttatcaaacattatgctaaacaactaataatgtacaatgtggtaattgcctgatagagacacaaaacactctaaatgagaacaggaaataaataattaatactttgggtacattgagaaacaggaggaagtgataattgaagcatggatgggattttagtaggcagggttggcttagaggtgagcaattgcattctagagtgaggataacattttaataagggtaaaaagccaggagcatgttctgggaaaagcagtaggtctgcttttgataggaacatgtttcccgggggttcgagggtgagcaggggcattgtgacctgaagccactgacaggagataggaatggaaagagtctaagtctgggagcggagtgcggccgacgaagtccagactgcatttcttgctgagtggtattgacacttttgtttgctgttacctcaaaataattttttaaatgatttatattgatattaaaattttttcatagtatctttttttttttttttttgggacagcatctcactttgtcacccatgctggggtgcagtggcataatcccaactcactgcaacctctgcctcctgggttcaagcaattctcctgcctcagcctcctaagtagcagggattacaggcatgcaccaccacacctggctaatttttgtatttttagtagagatggggtttcatcatgttggccaggctgatctcaaactcctgacctcaggtgatccaccctcctgagcctccaaagtgctcggattacaggcgtgagccaccacgcctggccaattcaatatatttataagcttgaaagtcttctattgatcattgtatcatccttctgtgtatcaaaatatatgtataaaataaaatacaaacattattctgattagaagcctccaaagatagatagatatagatatagatatagatatagatatagatatagatatatagatatagattttttttgagacgcagtctcgttctgtcgcccaggctggagtgcagtggcgcgatctcggctcactgcaagctccgcctcccaggttcacgccattctcctgcctcagcctccagagtagctgagactacaggcgcccgccaccatgcctggcaaattttttgtatttttagtagagacagggtttcaccgtgttagccaggatggtttcaatctcctgacctcgtgatccgcccgcctcagcctcccaaagtgctgggattacaggcttgagccaccgtcctccaaatatttttaagagaaacatttcctttggattgttattaaattattactagtatacatttcaccaaaacagcataaatattaaaattgtttgaaatgcagtctttaacggcatggatgttgggggtgaataggcatgagaactccttatgttgcttaaaaaaggcaacttcacgtgttctgtgtttggtgacctgatgccattcagtaaaggggagagagagggaggtgtgagaggatacacaacatcaagccttcaccacagacaatccaggtttaagaaaaactacaaaagaagttgaagacctggaaatggacctaattaaaaatactctcaccgccgctttgttccctccaggtctacctaccctttgcccatttgaagactcagacttacgttatggtttgtaagaaaaaattgtgagacctggatagtgcaaagttacactcaagagatggacttagaaaataagagacttctgagggttgggtagcaccagaaatacatattatttgatggggtgtagtggatgagggcaagaaattcagaggttttgaaactgggtaactgagcaggaggaggctgtcatgctctgacaaggaaatattgcgttcatttttgaacttcttttatataatcagtgattatgagaaatcaagtttatttaggagaaaataaaatcaaacacccagatgggagtattccatttgtttttagttttaatgagtcgttttgaatgtgtaatcattgaacttgtaagggattgaatttccctttcttcatttcactcagccgaagacgttttaaaatgttaattttactcagagtagcttcatacttggtatatgttatttcatctggaatgcgttcttgcactttctgagactaagtcttagataccccttgcaaaataattcccagttttctctgatgaatcgtgcccattagtgaattctgtggagagatgatcctatgaggatagggcaatagcaatcatctaaacattatatagaaaatttttgatgaggccgggcacagtggctcacgcctgtaatcccagcactttgggaggccaagacgggtggatcacgaggtcaggagtttgagaccagcctggccaacatggtgaaaccccgtctctactaaaaatacgaagaattagctgggcgtggtggcaggtgcctataatcccagctacttaggaggctgaggcaggagaattgcttgaacctgggaggcagaggttgcagtgagccaaaaacgtgcccctgcactccagcctgggcaacactgcgagtctgtctcaaaaaaggaaaagaaaattgttgatggtccccatcactctccttccttcctagttcacttcagcatattacacattttgttagactcatctttgaaatatctttttccctagctgtcttctatatttgcagtctctaagtttgaaacattaaaaagtcagagtacttgatgtggaaatcactttttctcacctaagatagaaggaaattcttatttatttatttatttatttatttatttatttatgagacagagtgtgtctctcttgcctaggctggagtacagtggtgcaatcttggctcattgcaacctccacctcccgggctcaagcaatcccaccacctcagcctcctgagattacaggggtgcaccaccactcctggcttatcttagtattatttatggagacagaatttcaccatgttgcccaggctggtctcaaactcctgggttcaagcaatctgcctgcctcagcctccgaaagtgctgggattacagacatgagccactgtgcctgttctgaaggaaattcttagcatataaataaataaagtgtactggatttccttaatcattgttatttaggcttatgcttacctagttctttagccaggttaacataaggtattaataatgtaatttacaacacatttgctcattggaaagatctgatcattggaaacacaaagagagcactgcaaagcctgctcttaaaaaaaatcaactataaaaataaaagacaaaaaaccccaaaagaacaaaatccaaaaaaagaaaaaaaaaaccaactgtgatgttacaaaaattacaaaattgaacatttcaaaatgcttctgtatcaaatgacttcttctgttaacattgggcaaaaccttgcaaaaaagggtaagttagattttttttttatttgtagagaccacagactgccagaaaggggaatttaaaattacaatttccccctctaatataaataaatctatatttttaatgcataaaattgtgacttctatttcattttaaaaaaacaacattttttagaaagctcaagtcttaaaagtaaatttggcttcccaaatggaactttttcttcatctctctttacatgctaaaggagctgtctgatcctatagctttggagctcatgtgtttaaaaaagcagattaaaatctcaagatactctgacaaggtgtacttagacaagctggcttaccatgtagtaactagaaatgcttttatttacgttccaattaaagaactgacatgtgaaaacaattttaccaagtgaaaacaatttaagtagaacagggatggaatatgtctcttgttgccttataaaaaatatatgtttatcagtttgtacttaaaatccatattgatcagtagcaaaagactgcaaagatcccattaatttattatttaattttaagtaatgtaataagagctagttaacttagtttaaacgcatgagacttttttaaaaaacccacccatttctgacataaccaaactgaggaaaattttgcaaattatgaaaattaaaaattacctttgacatatataatattacatgtattttatatatcagaaactatacaatataggccgggtgcagtggctcacgcctgtggtcccagcactttgggaggccgaggtgggcagatgacctgaggtcaggagttggagaccagcctggccaacatggtgaaaccctgtctctactaaaagtacaaaaattagccaggcatagtggcgcacatctataatcccagctactcgggaggctgaggcaggagaatcgcttgaacccgaggggctgaggttgcagtgagctgcgatcatgccactgcactccagcctgggcaacagagcgagatgccgtcttaaaaataacccaaaaagctacataatatatatcagagactatgtataatatacataatacctatatattttatgccttgttttagaaagactactttctactcttctcccactcccagaaatgatttattgtttgttaacacctttatgcaaattagtttgtgctattcctcaagaattagtgtatgtatagagaggattacaggtagatcaatccataggaatgatgctcttgtgagagacatttgattgagcaatgtcgagggcactgggtttatattccattgccaccattgtgctgtggtcatggcatttaatttctctaaatctaagatcgcgtgaagtaaaactactacgtttttttctgaagtctaaatgagacaatgaatgtgactcagcacattgtctagcacatacagatgcaaactgctatcattactgttgctatttatgctactactactgaagcaggatatttccctgatccctttgcaggcaggaactagagtgcacaggcactagaactagccagccacttcagtgtcagcaggggcagagtctacttgcttggtcctgctgtgttccacagctcatgggtgggggagtgcaggtgagcgggtgcaggagctggggcaagtgcttttgggtgctagcaggcaaaaatctccatggaggccctgcagcagtttctagggaggtgcccgagacccctgaagccccagaaggaatgttacagtgccattttagctttgccattcgtggacggcttaagtgttaacagctaagtggagggtgcacacacactcgtggcacccaaattcttgtctggcttccaggaggaatgaggttgcatgatcgaattagagatggtaaatgcagaggatttttattactgatgaaggtggctcccagcgggaaggggagctgaaaaggggacggattgggaaggtaatctcctctccgaagctacgccttcaagctgtccctctgaagtcaagctgcttctctctgacgtccaactacaatctccagtgtccagctgcttctcctttgtctgctggctgagcctggggtttttatgggcacagtaacgggggggggtggggaaggctatgggtggttttggaaaggacaacatttgagcaggaaaacagggatgtaagttctcattttgggctgcagttccaggcttgaggatggagccctcaccagggacctgcccttttctacccagaatttccctgcctcccctccctatcactactactgtatcactaatagtgccgtaatttggaatgggctagggagccttattagttcctctgtaatcattccaattaaatgacttcttatggcccatttttcaaatacttttttttaggtcgacgacttgtaattatacatatttatagggtacagtttgacatttccattcatatgtatgttgcataatgatcaaacagggtatttagcttgaacatcactttacgtgttcatcattgctttgggtgtggacattcaaaagcctctcttctagctattttgtaattacgttccatggtttttttgtttgtttgtttttggttttgttgagacagagtttcactcttgttgcccaggctggagtgcagtgctgcgatctcggctcactgcaacctctgcctcccagattcaagcggttcccctgcctcagcctcccaagtagctgggattataggcacccgccaccactcccagctaattttttgtatttttagtagagatggggtttcactatgttggccaggctggtcttgaactcctgatctcaggtgatctgcccacctctgcctcccaaaatgctgtgattataggcgtgggccactgcaccccaccctgttccatgttcttaagacctaaagtcttaaaataactttaaagctaggcatggtggctcacacctgtaatcccagcattttgagaggctgaagcgggaggatcccttgaactcaggagttcacttgaacctaggaggtggactctgcagtgagctgtgatcatgccactgcattccaacctggatgatggagtgagaccctgcctcaaaaaaaaaaaacaacttttaagacttccctttctgtacaatgcatttaagaggtgggggagagaattgcctattcctcttttcttcttttaccttctttctcatttttatatgcttttcaaatgaagaaattttttctttttgtatctatttattttttccattctctcatcatagctccagggacaacattgttctaatggtaataacttgttcaggaatgagtctaagatgttttgctgattcttatctctgattctcctttgtttgttgttttcatattcagatttctctctcctgttatgctaatgtggaagtattatgatccccttgagtctaagtgcttgggtgatttggaccctgcttaaaagaaaggttttcttccttcgtttttgaggaaattgggctcagacctaatgatctactgtcaagaaatactgttagctttatatgttagtctttgaaaatcatttcatttttctcaaactcactagatagtatcacatataattttataatttagttgtttcaagatgatagcaagagtaatgaatccttcttttaataatggttgttttcagcaatgattagttttttattctatttttctcaatttttcaaaatttaaagaaacatgcattgcttttaatagagaaaaaatgtatatttttaaagaacaatggagatattttttcattactttatgtgcactacttattttatgcgttttttttctaagggaatgggacaggttcagccttataagatactacaagcccaaccctcaaatgtacaattctctctttagaaggactttaacaaaatgtgtagtaattggtatatttaataaaaaaaaaaaagtaaatagagaatcattaagtgatctccaagtatgcttatttttctaaatatacttttaaagatatataagtggtattattagacttagaaaagccagaagaactgatatggcaggtcactagattattttataaaatatgcagccttgtttgtattttaagacactaggtatattatgtgtgtcaaaatcagatcaagttagaattttgagagtttactatgcatgcaaaagaaaagtttatgaaccagaaagacctcaaactgaaaaatggcacgaagtctcaattttacagccattaagacagcacagttcatagactgtaaaataggaagtattttgacctttcccatgattggctgtcctatattcttctttaaggcaaacaaagatgtgtaagctgatttgtctatagttgattggtttaacttcactgactcaaaaggacaagaagtttatgtttgtgtttggggttattgttctgtggaaatcaagatgccttaagttttggttacctatgtacagtggccttgtgtatctaaactgtgtccaccatttttatttattaaacctatgttatctttgcagtttgtctggaaacttttttttttttttttttgagacagagactgtgtcacccaggctggagtgcagtggcacaatctcagctcactgcaacctctgcctcctggattcaagtgattgtcctcagcctcctgagcagctgggactataggtgtgcaccaccaaacccagctaatttttgtatttttagtaaagacggggttttaccatgttggccaggctggtcttgaattcctgacctcaagtgatccgcccacctcagcttcccaaagtgctggggggttataagcgtgagacaccgtgcctggctaggaaacgtttttatctttaaaaattgaactctacttggggtaaaaccttttgttgctcttgcaacagttaacttcttcttcccgtgttttaccttcataattgataggcacttccatcctaatatttattgaaaaatagttaagaaaaaggatgctgtgctatgacaagattgggttctaaatccagttattccacttactgctcttgactatagacacatcattttattttatttttttgggacagggtcttactctgttgcccaggttggagtgtagtggcacaatcacgactcactgcagccttgacttcctgggctcatgtgatccttctacctcggcctcccaagtagctggaactccaggcacacactaccatccccagcttttttttttttttttttcacctgtagacatggggtcccactagttgcccaggcttaacttgaattcctacattcaagctatcctcccaccctggcctcccaaagtattgagattacaagtgtgagtcactgcatccagccagacatatcattttaaacatctctaaactttggtgtttttatccgtaacatgagaatgcatcagtggattaatcaaagtccttcaaagaaacataatatgtgtgtgtgtgtgtgtgtgtgtgtgtgtgtgtgtgtagtgagggagaattcactcttgctctgccattttgtttaatttgagccctcaaaggattggatgctacccacccattgatgaggatggatcttcttttactctgtctgctgattgaaatgctaatctgttctggaaataccctcacagacacccagaaataatgttttatcagctatctgcgcattcagtagccctgtcaacacgtaacattcacaatcatagtaaggataaactaagttatgttgtatagtaaaatcgcctccaaaatctcagtggcttataccaacaaacatttatttcttgttcatgttacacacccatcatgtactggctgaagttctgttctagttttctccacttcagaacttagaccatggagttaggggggaaaagagactgagagaatcactggtttttttgtttctatttttatttatttatttattttgagactgagtatcgctctgtcgccaggctggagtgcagtggcacgatctcagctcactgaaatctccgcctcccgggttcaagcaattctcctgcctcagcctccccagtagctaggattacaggcacgcaccaccactcccagttaattttttttcttttttgtatttttagtagagacggggtttcaccacgttggccaggatggtcttgatctccttacctcatgatccatctgcctcggcctcccaaaatgctgggattacaggtacgagccaccgtgcctggctgagaaccactggttttaagtcttttatcctgaagtagcgcgtgtcatttctgcccacatttcattggccatcccaagtcatatggctactcctgcctataggcaggggttatactactcccacagagacagaagccagaatacttactggcaaacagtaatacggtttaccgcagaaacagtaaaaaaaaatacctatgtcatagcatcaggagtcaaatgagatgcactcaaactgttccgcagactgcctaacactgagtaagtgcttcattgacaaacaaggcaattagatgcttacacgtttatagaatgcagaggagattattgtctactttgcatccccaatcccagaaagatagtttgatgtttagtaagtatttgcttagctacatcatttacataccaaggaagtcttaactaaagcagttaaatcactaggccatttttctgtgtactgcttaaaccatggaactaaagttacctaaggtaagcctcagtttggataatcaggtcatagataaatgacttaaatattttaagataaatctttaacatctgcctttccattggattcctcaattatgtatatcatatttaagagaagccaataaaactctctgagctgacggtacagcctgagctgccctttccccattaaattgatcagctattgattcgttctgttggtgtgtagcagtcttttcttaaatggaacaaaggcaattgtgtgtggattttaaggctttttatagcgtatacctgttcatataatgtttgtttgaatcaccaaagattttgctgttagttttagtttttctctttgttattttatttcaaaactaatacagcaaaattgagtttttcatatgtgttccattctatgaattttaaaatatatatatatagatacatgtaaccaccaccaccatcatcattagacaaaaactctattttgatttcttgtccttaacagagcagaataataatttaaaaataaaataggctcggcgtggtggttcacatctgtaatcctagcactttgggaggctgagacaggcagatcacctgaggtcagaaattcgagaccagcctggccaacgtggtaaaaccctgtctctactaaaaatacacaaattagctgggcgtggtggcacgtgcctgtagtcccagctactcaggaggctgaggcaggagaatctcttgaacccaggaggtggaggttgcagtgagccaagatcgcaacactgcactccaacctgggcaagagagcaagactctgtctcaaaaataaaaaataatgaaaaaaataaaacactgataatattagttgaaaataaatgtgtttgtgtgtgtaattataactgttagcattttatcattggtttcaagatgtgtatttctatcttcataatgtaaagcctgatgattgtgacactaagatgaattggtaatggtaagggaacactgaagtccttttacatttctgtgaacgctaattacaacagatgttttgtctcaacctgttttagcacaaatactgaaaacgttaactcttagcagtttagaagagaatttcctgttacagttaagttatagatcaaatgtaaattagaatctgttcacaatatctaatctttgtcatttgggtcgtaagaattggaaagtttcctttcttgcgctccctcattcactttctgatgcgattaatgaaaatgtattagtaattgctagagtaaatacagatactggtaatttacttagtagctgttacagtgccattaatgaagtaatggatgaaatatgtttctggtcttattctatcttatatgacttggtaagtgtcgaaggtgaatccagaaataggatttcctagaacactggcattggtctttcgaacattgcctagaagtctttgtaggacttatgccaaaataaccatactgatttattgggacattcagtcatttatacattcaactacaatgtaagtatttggggccaggaattgagcaagggaatagggaaatgaacataaacaagatatacctgtgggatatgaggatgtatggtttaattgcaggatagggaagtaagtgctaatacaaatctatacattgtgctttggcattgagagtagagctatcaactgtctggaaaaagatataaaaaacataatatcgttacagcagggatgaaagcattatgctgagtgaaataagccagatacaaaagaacaaatattatatgatttcaattgcagtagttaaattcatggagacagtagaattgtggttatgagaggcttgaggagcagttatgggagagttgtttaatgggtacagagtttcagtctgggaagatcaaaaggttctggagatggacagtgggtggtggtttgtccaacattgactggacttaatgtcactgaactgtatacctaaaaatggttcaaaatcaaccagtcttgcctgggcacggtggctaatgcctgtaatcccagcactttggatggcagacgtgggtgggtcatttgaggtcacgagtttgagaccagcctggccaacacggtgaaaccccatctctactaaaatacaaaaattagccaggcatggtggcgggcgcctgtagtcccagctactcgagaggctgaggcaggagaattgcttgaacccaggaggcagaggttgcagcgaacggagattgtgccactgcactccagcctgggtgacagagtgatattccctctcaaaaaaaaaaaaaaaaaaaaaaaaatcaaccaggctcagtgtcatgcatctgtcgtcccagctacttgggaagctgaggtgcgtacatggctccagttcaggggtttgagtctagcctgggcaacatagcgagaccctgtctctttaaaaaaaaaaaaaagtttaaaatggtaaattgtatgtctgttttaccacaataaaacaataaaagtaggaattttaaaaatataatatcattatcattaatagtcacattctcttcattttaagagattcttaatttaaggaatttttatacttttcccccacctttttttttcttttcttttttttttttttttttttttgagatactctatcacccaggctggaatgcagtggcgcaatcttggctcactgcaacctccaactcttggactcaagcaattcttgtgcctcagcctcctaaatagctgggattacaggcacacgtgaccatagtcagcttttttatatatatatatatgtattttgtattatatgtatataagtattttgtattattagtagagatggggtttcaccattttggccaggctggtctcaaactcctgacctcaagtgatgtgcctcagcctcccaaagtgctgggattactagtgtgagccactttatccagcccacttttctcccattttttgtctctgttataatttttctaataagatcttatatgtaccagctaatctctagcaaggctatgccattagaatgtttgtgttagagccaggaaatgtgggtgaaacttgctttgccaccttagtcaagctaatataattcagaacatctgaaatagttttgcatgaaatgatatatttaataaattctaaattcccatgttttattatttaattgaaataaggctaggcatggtgggcatggttgctgatatctgtaataccagcgctttgggaggctgaggcaggaggatcatttgagtgcaggagttcaagatcagcaagcgtgggcaacatagtgagaccccgtctctaggaaaaatgtaaaaattagcctggcgtggtggcatgtgcttgtcatcccatctactcgagaggctgaggtgggaggatcacttgaggtgaggaggtcaaggctgcagtaagccgtgattgcacttttgcactccagcctgggcaacagaatgagactctgtctcaaagaaaaaaaaaaaaagaaataaatccttagatgttacaatatggttaacccttgaaaccaataagtgaaagaagccagtcagaaaacaagtcacatattatatgagtctatttatataaaatatccagaataggcaaatctgtagagttaggaagtagactagtggttgttttagagctaggagaagggttcatgaaatgagggaaaatgggagtggctgctaatgggtacagggtttgttttgggggaaggaaaatgttctaaaattagattgtggtaatggttttacaatcccgtgaatatactaaaaaatgttaattgtatattttgaatggataaattgtatatgaattatatttcaaactattttaaaaatatttaaagggaatggtatagtttgtctttttttggaggttttttttttctttagcatttaacttaaatgagctgaaaacaacagagcagtgtaaagtttagcattttgaacatgcatgtacttcataacaaagctatcatctgagagggctttctgtttgatcgctattggtgtggatgtaaacgcatctcaatgcaagtgtcaacatattcttcacatactgagtgattgcacaggggccatgctagtgtcattccaattttagtatatgtgctgctgaggcaagcacatactgagtgattttgttaagccaatagtacatatattcaaaactaggtagaatgtaatgatgaatttgatgactatagggcaataaaaatgaaatttagcagttcttttaaaaacgtatccatacatagaactgctttttaaaattaagtctgttttcattcaatttatttttttctttatattttaagttcagagaaaaataacaaacattgagatgattatcactttgtaagatgaggattccatggaatagtaccagatggaaacactgttttttaatctggttagccattctgcagttcctgcctgtaaaatggttaatatctatattttaagcagccttaatacatcagcccttccattataaatgacccaatattaaaacacatactttttccatgctcgctgctaccagagctcctcaactgctccccctcccatgtgagcagatacatgcccaccaaatctgcccttcagctcagactcacccagctcagagcaccgagctgctcatgactgcccttctttcatcagccacaatttgagctaaatgcttctttttcccttggtaaacctgagacccttcccttcacttgtaaattactttcataagaaaatgcattgtgggctgggagcagtagctcatgcctgtaatcccagcactttgggagtccaaggcagggggatcacctgaggtcaggagttcgagaccagcctggccgatatggtgaaacccagtgtctactaaaaatactaaaattagccaggtacggtggcaggcacctgtaatcccagctactcaggaggctgaggcaagagaatcacttgaacccaggaggtggaggctgcagtgagcccagattgtgcctctgcactccagcctgggtgacagagtgagatgaaaagaaaaaagaaaagaaaagagaaaatgcactgtggtttcaatctcaagcttcagcatacctttagaaatataatccatgatggggctacctttatttaaagtgtcttcattgttacaggcatacctcagagatactgcaggtttggttccagacctctgcaaaatagcaaatatcaccataaagcaagttacgtgaattttttagtttcctagtgtatgtaaaagttatgtttatactatattatagtctagtaagtatacaatagcgttatgtgtaaaaaatgtacataccttaattttaaaatactttattgctaaaaaatgagccttcagcgagttattatctttttgcttgtgatgggtcttgccacgatgttgatggctatggacttatcagagtggtgattgctaaaggttaagaaaggagctgtggcagtgcagcttctctcaaaattggagtcaaccctgtcaaactctgctttatcaactacatttgtatattatcataaatactttgttgtcatttcaacagtcttcacagtgtcttcaacaggaatacattccatctcgaaaccactttctttgctcatccataagaaacaactcatcatctgttcaagtttgatgatgagattgcagcaattccgtcatatcttcaggctccacttgtaattctagttgttttcctgtttccaccacatctgcacttactttctccattgaagtcttgaacccctcaaagttatccatgagggttgaaatcaatgtcttccaaactcctgtttatattgatattttgttctcctcccatgaatcatgaatgttcttaacagcatctggaatgacgagtcctttccagaaggcttttaatttactttacctagatccaccagaggaatcactatggcagttatagccttacaaaaatgtatttcttatataatgaacttgaaagttgaaattactccttggtccatgtactgcagaatggatgttgtgttagcaggcacgaaaacattaatctctttgtacatccccatcagatctcttagatgaccaggtgcattgtccatgagcagtaatattttgaaaggaatctttttttcctgagcagtaggtctcgatagtgggtttaaaatatccagtaaaccatgctgtcaacacatgtgctctcaccaggctttggtgttccatttatagagtacagacagagtcaatttatcataattcttgagggccctagaattttcagaatggtaaatgagaattggtttcaacttacagtcaccagttgcattatcccctaacaagagagtcagtctttatgtcctctgaagctttgaagcattgcttcaaagccttttgtatttacttctcttctctacctatgaaagtcctagatgccaccactttttaatagaaggctgttttgtctacattgaaaatctgcggtgtgccatagccatcttcatcagtgatcttagctaagtcttctggataatttgctacagcttctacttcagcacttgcttattcagtttgcactttcatgttatggaaacagcgttccttaaacctcatgaaccaacctcttctagcttcaaacgtcttctgcagtctcctcacttcaatcagcctttatagaattgaagagagttagggccttgctctggattaggtttgtgcttaagggaatgttgtggctggtttgatcatctatccagacgactgaaactttctccatatcagcaataaggctgtttgactttcttatcattcatgagttcactggagtggcacttttgatttccttcaagaacttttcctttgcattcataatttggctgactggtgcaagaggcctagcttttaacgtgtctcagcttttgacataccttccccactaaggttaatgccttctagcttttgatttacagtgagaaacgtgggacttttccatccacttgaatatttaaaggccttcgtcaggttattaattggcctaatttcaatattgttgtatctcagaggatagggaggcccaagatgggaagagccagttggaagagcagtcagaacacacacaacatttattaaatttgccatcttatatgggcgcggtttgtggcaccccaaaataattacaagagtaacatcaaagatcactgatgacagatcatcacatcagatacagtaataatttaaaaagtctaaaatattgcaagaattaccaaaatgtgacacagagatacgaagtgagcacatgctgttgaaaaaatttgccagtgcacatgcttgacacagggttgccacaaaccttcaatttgtaagaaacacaatatttgggaagcacaataaaatgatgtatgcctgtacttatgtatatacctatagatttacatataattattcatttgttccagaaattaaggcaggctgattaaatgcctgtttacctacttgaatatatgtttgtttacctggtcgagccaaactgaaatattactgaatgaaagtttgtcttcctattgaaattacaatttacacctcttttcgtgtatgttgatgtagttgtaacccatatctgtatttaaatgtttagtggtgtgcttagcacagtataagctattgtagaaatgcagagggaagagtaaaatataatttctggccttgtagcagccttgtagcattcagttctggagattcattattgtattgccaggaagagctaagtaaacactttggtaacaccaggaacaagttgctgagaagtcataaaggaagaagattctgaaagatgaagagaacacaagttgtcctaaactaagagtgctgagcaaggagaggaatggaagagaaagcaaaacaaaaaatacatactttgtctccttggggacattaatctgtgttaagtcatgattctctcagtggtagaaacatggactttaattaaggggcaagtgtatttttattttgtgttctagcagtataaagttgcaaggcctgtagtatgaagctaaagataattactagtgggaaggtttattttgagaaccacgggggtggcggggggagggggaaaccactacatttatcctacttgtttgctattaacattttaatttgtaaattggcatactgtagcagggcaaagtttcatctagctcagtatcctgtttatagtaagaggccaccctgagtgtttccaagagaaactgcaccaccctctctggcccggggtcatgtttgctggtaaacccctttcaaatttatgtcatgcaaatcagtaccagttatttctccttcacttgctagttcgggaactagcttatcagaaagctgttttatttattgataggttccctgtaatccatataaaattgtgatacagggaacttaaaatacttaccaaaagaaaaaaaataaaaaattagatgatttacatatggagtgcttactctattagcatatactggattatcttaatttattttcacaatagcccagtagccctatgaggtgaatattatccttctctccattttatagatgagaagaaggtacacagcctgagtgtgaagtttcatctcgcaaagtgtattacatgtcaagatgtcatttctcaccgcaatagatatgtctaaagctgtgagtgctgccactttagaaaacaaagatctttgtacagttatgtttcttaaatttgggggggattttgatgttcaagtgtgaagaacctgaaaggcagagtattctagcataaggccagcatatttactgtaggatgcgtaatgtgagtgtggctctgcctcgcccagctccaagtgtgcagtatggctacaaagaggctgctgaggccaggcgcggtggctcacgcctgtaatcccagcactttgagaggctgaggcaggcggatcacctgaggtcgggagttcaagaccagcctgaccaacatggtgaaaccccatctctactaaaaccacaaaaattagctgggcgtggtggcacatgcctgtaatcccagctacttggacgcttaggcaggagaatcacttgaacccgggaggtggaggtggcagtgagctgagatcgcgccagtgcactccagcctgggtgacagagcaaaattccatctcaaaaaaagaaaaaagaaaaaaaaaaaaagagcctactgaatacccagcccagaaatgtaacagtttcatgaaagtgtatccagctgcttttctactaaataagaaattcttcaactccaattccaatttagtagtctatatgtaacaaggttaataaggtatatacctattaattcctggtagagaaagtgtggataaaggatatctatgagtaattgtatttgataatcttagtgaaaggattattttaaacaaccgctgctaagaaggtgactgatttgagttcatctctgggcttcccctttggctaaaatgctaatgttcacagtcaatgaaaagaaaatggagaaacacagggcatggttgatccgtatgcatgactaactcttgaagagctgagaggtaactggacggaattagctggctctttgattccataagatccttcaaaatattttttgaaggatgaaatgaggtaacagatgtgaaagtgcaatactttgaaaactaagaatcactggacacatgcaacttattaatgagccactccctttatgacatttttattcactactggactctgaaaggccgtatgtgcctgctgtctctttcttttcacttttctttttctttttttctttgtttcttttcttttttctttttctctttctctccttcctttcctccctctctttcaaatcgatgacctgacagcatgcagcagtggagaagggccacattagtcatcttacctaatgcttacatgaatggtgacattacagaacttcacctctgtcactctttcttattcgccccctttgtatccttggaggaatttttaaacactctctgagtttttaatgtttttcacttaaatgtattctctttcgcttggcaagatacgttcttcttaatcttcatctcttctttctcttctttttatgcatcttaagtatgaaagttagtaggtgcccagtggtgaagtggctggcctcactgtcgggtcatgtgccttttgcgtaatagatactcaaaaaatatgtgactgaaattaaaaaaaaaaaaaaaaaaaaaaaagaaagaaacaggtgagttgtagagtttttttcctgattttttttgtacaaatatgtcatttgtcttggcaataatatttgtattaaaaaatgtgttaacctaaatttggaaactttctgtattccagtataggggattatgggatctcaagtgtttgccttaaatactgatgtttttcccacaaatgtaacaaggcagaatgtaaaactccttggaagtgaagtagaaatggtgtttgttttggaatcctgaaaaatctttttactctttaggcattatgtgactttatctctgttttgtcacctaagagaaacagcgagcatgaggaaataattgttgtgtggaatcctctgaaagtgatattgaattcccaaatctcatcatagaatattaccaactgatgttcactttaagagccttgatgattggtctgttttcagctagtatgtttatttgcttgcgcttgtggtgttgatgtgaggaaaaccattccacaatttgttaaaatgattagtgttttctccttccatttttttaaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaagtaagtctgttagtacttaagaaaataaccatttcttttttctttcaaaagcttgtggcaaaaatgcacttattgcagccttacaattaaaggtacaagagagaaggcgagactttcgaagctttcaaagcctttaagtctccttggcacctttgatgtggttttttctttctcctcagtttatatccaccttccatctgtacatgacacaccattaatttgtgtaagattgccagtctttttaaggtaatgtgaattgtgattatttttatacctgacctggtggatgaaaactgctttagctttgctctgtgtaaatctcctttaatgtggctttttgaagttatgagctggttttgacatggacagaggccaaattgtgtcactacaaaatagataattttctactaaacagcattttttaaagagtatctggaatgtctatgcttttacacacgaagccctgcagtttgcttaaagaattgtgatttacaagaaggtttgaggattctactttttaaagttcaaattgctattgaccaaaattaaggcatatttacacaatgtcagacatgaatgataattttgtttccacagaaaatactttcagcccttaattatgttcttcaaaaccctgctcctcatcatcaccaaacattgactgccttctgtgattatgctaggcaggaaatggaagtgttggcccaggtcacacagagccttctcaagtctacatcactgttctcccctctggggatatgtcatttgtcttggcgtatttgtggcctgggtcttcctacttttcatacattttttccatagccttttcctttgttgtttttcttaattaagatacaactttttatttccatcgtcttgtttataattatgtacctttgtactatgtcagagtactgcatggatacgattgctttatacaaattgtaagcaattattttttccacctttaattagtcatttatcctaactgcatatgatcattttaaaaatctttttcttttttttcctttttctattcttccatacctttccattacatatctttctaagtttttttttaacctctaggcattcttgattatcctaaccaccaagaataaagctacttagtgtacattcagacaaatacagctaattgtccaaatattcaaatcagtgcatagaagctgtatttgttaagtgctacagccttcaaagtggaaaatggaaaatagatctctaccctttttaatactttcaaatcttgaacagaactgtgttaggctaaagaatatagatttttatttgtttaagtatctgctgttggcctatagccctttcttgcctttcttctattattgcaggcaaatttgtctcatataaaagagttcttttgggcactctggcactggtaaatggaatattttcaaaatttcaagtcagttgcacttgtgaaatttcttccttctttgcctattacagcagtagccaataaaaacttgatacttgttacacaatattttcccaagtataaacatgcatcccgggtgcagaatagactagaacactttccagatagtttgttgcattagtgtgattaaacgaggttaaggaatcagcacctctcttttatctttatttggttgagggctgactcagttgttggaggaattactgtggctacttaaatgggcaacaatttcacaagttacgttgttctggaggtctgttaaatctgttccatcttggacagttccaacagcctctatgagctatatagaggtaaaaagatgatcatgtcaggtattaggaaatagtctcttggatttctttggatctgggtcctttcgttggattctgagttattgtgaggcatctatgtagtttttctagaagtattcaaccaactggaggatcctagaaccaactatgtttcccagggatctctagtatttctagcaatgaaaatattagacatacctggagaagatattggagatgcctggagatcacactccatcccatacccccccatatatagtttcagtttcaagtgccatgcgtcaattagattgtagagtatgagtctagtcagttagcatctctgagagatttttaaattaacgctgtattgtgtatatgcagcaagggcagaagcaaccctggtatataatttcacatttagattataagtaagatatattgcaaaactgtagtaggcagccaatatgatatacctgcttatgtatagcagatgactgagaaaacttcaggtaacctattttaaaaaaaaaaaaaaaaatcagattatcactgccaataaagtgatcctaggcccagtgcggtggctcacacctggaatcctagtacattgggaggctgaggtggatggatctcctgagctcaggagttcaagatcagtttgggcaacatggtgaaaccccgtctgtatcaaaaatacaaaaaattagctgatcgtgttggctcgcacctgtgatcccaactacttgggaggctgaggtgggagaaacaattgagcctgggaggcggaggttgcagtgagccaagattacgccactgcactccagcctgggtgacagagtgagacctatctcaaaaaataaaaaagtgatccttgcatagttttagacagttcatcagaaccataaaattgtgtattttgtctagtccatctgttgtgaagaataatatagacttactcccatgaggacagtataatcagctttgccatttagcgaaaaagagttttcctgtcctcttggggaagtccatctacctggtgagtaatttccaactattatggacatttagaagtagatgaaatattttagactaggcacagtggctcacacctctaatcccagcactttgggaggctgaggtgggtggatcacctgaggtcaggagtttaagaccagcctggccaacatggtgaaaccatctctactaaatatatatatatatatatatatatatatacacacacacacacacacatatatacacacatacctacacaaaaattagccaggcatggtggcacgtgcctgtaatcccagctactggggaggctgaggcaggagaatcacttgaactcgggaggcaaaagttgcagtaagctgagatcgtgccactgcactccagcctgggtgacagagtgagactccatctcaaaaataaaaaaagaaagaaaaaagaaataaatgaaatattttaaatagttcttatgtttgacctaccttccgctataaaaactagtatagctttatgccaaatagattagtgctcattttggaaacaccaaagtttcagggctttctttagagccactagcctggataactgatccagcacaaaattgtcttgtccagcctttattaaaattcaacacagtattttcactcttggaggggcctaacactatcatgttgccctgatttgtgcctaacgctcattcataaaatgatcctgacttaaagtggtatgtttggtgctttctttttctgtttgctttttaaatcctttctaaatggcggcccatttcatttacatctctcatttcccctgaagtctttgaagccttttttgtaatgtgcctttaacaaataagtctctcttttttctccagcagtgtgaggcttctcaaatatttgtgttatgagttatggacaaggcatttcctgatctgtttccttaaaaaatccattttttaagacaacctatagcatttaagattgaaatccaaactgtgggagtttacctgaagctgcaagctttcaaactgctaattttgtggtattggtagagccatgaaagtggaagtgaaatctttttaattaattttctttgcagttgaaaatggcccatgttttagctggtagcaatgtaagtttacatatgagccaactaagctggttcattattctcttcagttgtttgaaagttggcagccatcatcacaacagcagctggatacaagataacctagcagtgttggcacatgttgaggcatatgggaatttattaaatcatgcaacctttgcaaagaagagcgtctaaatgacttaatatactaatttaaaacagctggccatgagcaatcatatgacttaaattattctattcagatttattaatccaattgaacattaactgagtaatttgatgtttttatctaaatggataagatgattttttgaagtataaaatgggatttgtagggataggggaagaaactatatagaacaaagcaagcggtgcaattctggttttagaaataatctgtgtttggctgggtgcagtggctgacacctgtaatcccaatactttgggaggctgaggtaggaggatcacttgagcccaggagttccagaccagcctgtgagaccgtatctctacaaaaaaataaaaataaaaaaactagctgagcatgctgatgtacacctgtagtctcaactactagggaggctgaggcaggaggatcactggagcctggaagttggaagttacaatgagctatgatcatgctgctgcactccagcctgcgtgacagagcaagatcctgtctttcaaaaaaaatttgtctttgtattttaaaatatgtatcttatatattttactatcattcattgtcacataactgatgtttctgttatcttttaaacttattactgagatgttttttaaagtataaaacatgaatgattcttttttcttttttcatgtgtttttgagagagttacttcccaattcaatgatttttgtactgcgttatgttggggatgatataattagggttcccagggccttgaggcattagacaattactttaattgggcctctatcatttgagcagcagtgaatgtatagtcactccccaacataaaccatgcattaacatatattcaaaaaatgacaacatgcgcagttcttaagcatatgttttaatgctaagtaaaagaatctttaagtcctcaagttcacacattaaaatgtgaaagaaacatgtaagaatatcctacggatagatatttaggaaatgaaacagtttatatattaaaagacctaactctttagacagagtattttgttagaagtccagtagctttttagtttatgttaactagaccttaaatagttaacatctctatctttctcacttggtaaatacaatttgaatgaattaataaacggttttgtttttacctgcaagttgcatggatctaacgttaagttgcatcttactgtggcgtctccatgttgatttttaatcccatgatattgttcattttagaatttgccattatcatttcttaaggtactgtgcacttcagggttaatttcccttgttgcttatagaatattaaccattttagcactgtgatatttattattattcccgtaagttcactatacccagagattgcccagtgaaataccacagctaataagcaatgagcactcatgggtaaaggggaatcttttgcagggcgaggagagaacaaactagaggggaagtagcagacttgcagaggaagtttcattctgtgatctctccgctgtatactcattcaatggaaggggcacaagggcataaagccagtattacttggctttatggcaggatgatgactgtgagtgagtcattgagctaacttatatcatccagcccatcctatgacctacttttccagtctatctgcaaaaaggatgctaaattattaacatcctgagtaatttttctttcctatcattagtcctggtcattcatgtgtgcttattggaacacaatctgataaagctatgttacattaaattagtattttattctgccttattcatctagttttagtcctagtggcttggaaacataagtagaatatttatcagaagaaaagaaaataaatgcaaaagaaaaaaaaagaatgattcagcaaggattagataattatattttcttccagatgcattcccagatgtgtttctgttcactaagtaaccacctccaaaatactttaggcaaaatgcttccctgaaaaatgttttctggctttatgtcatcatttctagtatctttagctaagttgttattttgggtagcactaaggtcgtgttcactgtttttatcttttgccaaatttctttctgaggtagtgaagttcttttcccttctctccattgctacttttagaacttttctaatgaatacatatatatcattggatcagttatttagcagaaaaacatatttacttttttttccttctccagtgtgttgttatatttagaagattatatgctaaatagattatgacacaatgtgctaaataccgtaggattctgggactaccccaaattcgattcactggtttgaaggcaactgttactttatgttgacttgctttccatttccttgtagtctggtcaagaaaggaacctcatttttcctaaacttcattcactttatatccttcctttacaatatgattatgttattcctttcagaaatcatcgtctcttaatctcttgtgcatttttcctgcctcagtggtatatcataaacataaaggtccaatcacatatacatgaagtagtagaataataacgtttttctttttttgacagagtgctttcatattccacagagcttgcatattaactcattatgttaccaaaacttagcaaagtacatagggttagtatttttaatttgcattttataaaacaaatgtcagggttcggaatggttagaaagagttgttgaggccaggcatggtggctcatgcctgtaatcccagcactttcagaggctgaggcagacagattgcttgagtccaggagttcaagaacagcctggacaacatagcaaaaccccatctctacaaaaattagccaggtgtggtggcactcgcctgtagtcgcagctacttgggaggctgaggtgggaggatcctgggaggcactcgcctatagtcccaagtagtcgcagctacttgggaggctgaggttgagcctgggaggcagaggctaccatgagccgagatcacaccactgcattccagcctgggcaacagagcaagaccctgtctcaaaaaaaaaaaaaaaaaaaaaaaaaaagcccacaatgaattaatgcatactggaactatataccctcagtttctactgtggttctttttaccagttccaatagcatatattaattaaatgatttctatttttatcggttatgtgtccagactagtaataaatgcaatggtaagtataccgataatacttaacatgataatcataataaaacaattatctaatatttttgggtgtttactttcatgccaagcactactgttaaagcattgtatgtcttagattgtttaatcctcaaggcccaaagatgttaagtaatttgcccaaagtcatgcagttagtgatagaaccttgatagaatccaggccaggggattacccagccagtgctcttatccatagtgttgtactgctggtctaatctaaggcattttcctctagcactggagacaataaagtggattcagcaaatattgaggagaagaaatttacaatgtacacttagaagagaagatgaggaaggcatgcatgggtgtcaaaagtagctccttggtatcttaagtaaggcataataatagaaaatcatatagttaacccagatagggaaatgagaaggaggaggagtttaggtaggaaagatgagtttgatgttagacatgctgaatttgcagtgactgcctggaaaatctaggatagagccccccttaggctgtagaaaatgtgggtcaggagccaaaaagaaagatgagggtctagagataaatgcttgggagtaatcagcatttgagtagtagatgaagttataggtaatgagatcatccagaaggaaaaatggaagggtaagaacagaagtctagggaacaccaatatttcagtaataatgggaaaggaaaaaggattctgtggcaggttaaaaaggcagggtcaggcccgtggaggtggagacccaggaggaaataataccacggaagccaagagacaatacagttgtaggaaaaggaagggaagaagggccaagtgttattgagagttgcctcttataagcaagcactgggctgggggctctggagaatatgaaaaaacaaaaaatattgttagattgctttcttttccaaatttcatgagtattcaaaagctattgagttgtactaacgtctaaagttagaaatcttcatggtccttttttgactgcagcatccccagttccttgcacagtgcttggtttgtcctccttgacacccccacaactctgcaccgtatatatggcaggaagggactcaagagtaagaagcagggataatacgtgtctgttgaatgaatggcacttaactctggaactaacaagagtaaggcttagagcagtatttcttggtctgttttaattaaagttctcttttcgtagacaagaaaatcctcttctctttgcagaaaaagtgatacattccttttaatagcacataatactttgccttcttagagattctgtggacccccgctggctaatagctaagaataattattaggcaatatttattgagcctataatatgttgaaatcagtgtagtttacatggtactaagtggtttacatgaattaactcatttaattctcacaatggcacatattatatacaaaatcttatccccattttagggttaagaaatttaggtacatagaagttaaataacttgcctgaagtcacagtgctaataattgccagagttcagattcaagctctagcttgtggatctccaaattttatttattgctattataacttccaagtaggatagtttttggaaacaatagggatgataattttccaattgaaaattatactacactattgaatagaaatgttatattatacatgccatctcctggacatttaatacaacattctatagtcaatatcgcctcctttttaccttcactctccatccagtcactgggtgaggggatcaataaagaagctgtgtttgttaaagcagaatgactatgtgctacagcagtcccactactagctgtttatccaaaggaaaggaaatcagtatcaaagagatacctgttcccccatgtttattgcagataaactatgcccaatagccaagataaggaatcagcctaaatgtccatcatcagatgaatggttaaagatatagcacacaccagaatactattcaaccataaaaagagtgaaattttgtcgtggcagcaacatggatggaaccaaaggtcattatgttaactgaaataaaccaggcacagaaagacaaataccgcgtgttctcactcatatgcaggagctaaaaaattgatctcatggagatggaacatagaatgatgcttaccagaaagtggaaagggaggtaggtggtgatgaagagagattggttaaggggtacaaacatatagctagatagaaggaataagttctagtgtttggtagcacagtagagtgactataattaacaacaatttattgtatatttccaaatagctagaagaggagatttgaaatgttcccaacacaggaaatgatacattttgagtaacagatatcctaaatactctaatttgatcattacgcattgtgtgcatatatcaaaataccacatataccttccataaatatgcatagtattacgtatcaattttttacgtaaaatgtttagaaaatgaagctatgtttgaatgtgaccatgaggagaaaaactacaaataaaagtaatgagtgttttatctgtaataacatctttaattataaaactgcagagtttcttaatgaagtatgtgtacgtgttttaaaatgaaatgctaatgccagtggttgttaacatgttgtgaagctattatccattctaaactacatttcaaaaactttaagccctcatgtcttcctcctacttatctttctttcttaaagccaagtatattaaatctctagcttaaactcctgcccataagcaccctgtattcctaaccagagatccatttcatcacttgctgcaggcacaaggagaaagagtcaatgatgggtcactgttgcctccttgtactcctccttatcatcattctcacattcactgagccctcattatgtgaatgggccactctaggaccttatattcctactgaaaatcaggaagaaatcaagggagcatgtacagtatgtgtacttttgaatgttctagtcgactttgcagtaatatcgaaaaggtgccctaattaagtcctcagaaaaaatgagaaaaagaagactgggtaatataaccaataatttttttaaaaggctgaatctcagattattaagatctgaccagggctgggcgcgatggttcacgcctgtaaccccagcactttgggaggccgaggcgggcagatcatgaggtctggagatcgagaccatcctggctaacatggtgaaccctgtctctactaaaaatacaaaaaattagctgggcatggtggcgggcacctgtagttccagctacttgggaggctgaggcaggagaatggtgtgaacccgggaggtggagcttgcagttagccgagatcgcaccactgcactccagcctgggtgacagagtgagtctccatctcaaaaaaaaaaaaaaaagccaggcacggtggcttacacctgtaatcccagcactttgggaggccaaggcgggtggatcacaaggtcaggggattgagagcatcctggctaacatggtgaaaccccatctctactaaaaaaaatagacaaaaaaattagccgggcgcggtggcgggcacctgtagtcccagctactcgggaggctgatgcaggagaatggtgtgaacccgggaggcagagctggcagtgagctgagatcatgccactgcactccagcctgggtaatagagcgagactctgtctcaaaaaaaaaagaaaaagatctgaccaatttgaattctggaaataagatcaaaatgtccctgtgaattaacattaatttcaaaagagattaaattttgcatttattctactagtatttattggttatagaccgtgtgtctggcacttgttaggtatagaatattaagagattagtaaaacttggtaactgtcttttagggacggatattcttaagttgtggttaatattaggtagatgtttataagccagaatgtttggtaagaatggtaaaaccccagtgttaaatccagtatgcaaggaacataaatgtttactataggctttttatggatgagaaagaaatactgaatttacaggtcttccatgaaaatcaatcccctttcttcacacaattatactttataggtttcattttatccgtgatatcattaaatctaccagtatagggaaaggttttaactaggttacatacatacatgcacacgtttgcatgcatatatatttatgtatataaaagttgtagtttgattcatctgcaagtgacagaaaaaatatggcataaaaaaaaagtttatttctcagtcatgtaaatgaagtccagagccagatggtggaactctgtaaggctccagcatgtcagagatgtaggattgaactttcatctcatggtcaaagatggctgcttaatctccagccatcacatctgcattccaaacagtaggaaggcaaggggcaaacaagagtgtgtgtttcttcccttgtaatacttcctgaaagtcatacccgtcacttttgattatgtcaaattgtcagaacttagtcatatggccacacttacctgcaagagaggctaagaaaatttagtgtttagtttgagttttttgtccccctttaaagagtctcttggaaagaaggggagatgaaatagtggggagcaattagcagtctttgccacagtcaccatttgtccattcttcttgctacatacagaacttactctaagagagagagccccagtcccatctagttaccctgtcctcttataagtacatgatctctgggtgatgctctgtccttttcaggaagtccaggtgtggctttccatgggctgatggatataagctaaaaagcaacctaacattcccaatataaaatagaatggaaataagagaatatttaaagctcccatttgaaaaatgggagaataagaaacacatgagttttcaataggaattattaaaccttgcttggtggaaatcctggagcctttctgcgcaagcactgaaggacggtctttagtaccccatctgatggcccctggctttcctctgtgagggatacgccttagtcctttgtcctctgttgctcctgtcttctgtgcccatatttgaggtggcattagggtgaatgctcttctgagtgggttctaatacttccttctcgtaccagcatgagccccggcaattgctttaggggttgtacagtagcggctgtgcagaccatcctgcattttggcagtccaagtccctcacaaacttagtagccttttagtctgtttcttgtcagttccattaacaactataggcaaaggtcttaactggacgtagttttgaacctaaagaccctgtcttttatttactggcctctgtccttcttccctactctgaacttactgatgactcctttgaggtcatctgaagcactcttaatcccatctctgccaagaaactcagctcatgtatgatggggcaccaaccttctgaggtggctatgatactgtagccaatgcttgtaattgctatgcttggctttttcagacctgcaaacatcaaaatcacaggaccctcagtcaaatttaattctaattcacaaggagagtggttttcttagcaaagctgtttcctctctctctcttttctttctttctttcttttttctttctcttctcttttcaagtataagtccatcttatttctttttttaacttttttacttttaagtacatttatgtgggtacatagtaaatgtatatatttatgggtgcatgagatactttaggcatacactccataataatcgcagagtaaacgaggtatctgtcacctcaagtaatttacaatttcagcaaagctgctttcttactcagcttgcaaccagctagccctagtctgagttccttgttactaagagcagtaagaaggagccagctatattcaacattctgaattttttgtaatatctctatagctatagactaagttaacatttgtactgtcttccaagttctgcaggggacaatgtgaccagatattttgctaacataacattaattagttttccagcctgcagtatgagtccttgctgcccaaaatgtgacaaacgagtatcacacttttagattctgtcacatatagtatcccactttgattggattggtttgggctgtcaatgaccaaaaacataaaacagtgtctcagacaagatagatagatatcactttctcacattaaaaaagaaaagaaaagcttaagatgcttaagatgtagcaatcttgtgctggtggacagtccacagcatcaatgactcaggattctgtcctgttgctcagctgtcctctgtctcatggtccatgatgactgctgaaaattcaacctccacgtctgcattccagccaggaagaaggagaaagagttaaagaagtgtgtgccccaccctaccttgaaggttactgtctttgaaattgtacaggacacttcacttatatctcactgattagaacataactttccctagctgcacggaaaactagaaaataacacatttcttctggacatccatgtatctagctcaaaatccatttatatgggagatgaaaggaatggatataaaggggccactgaaaatctccaccacaataggtatgtctaaaaagttctcgggccgggtgtggtggctcacacctgtaatcccagcactttgggaggccaaggcaggtggatcacaaggtcaggagatcaagaccatcctggccaacatggtgaaccctgtctctactaaaaatgcaaacaaacaaaaaaattagctgggcgtggcagtgggtgcctgtagtcccggctactcaggaggctgaggcaagagaatggtgtgaacctgggaggcggagcttgcaatgagccaagatcacgccactgcactccagcctgggtgacagagcgagactccgtctcataaaaaaaaaaaaaaaagttctcatgttgtagggtaataacttcccctaaaaacaactgaattttttttatcatatctctaagtatctaattatgttctcttgagcatcaataccgaattttgcacctggctcaatatttggtttttgttctcatatggtgacaaagttttcatttttaaaaaatgcatatctcctattttaatctcacaaattaaacaatattttgaagattatcagctgtctgtgttgagtgactatcagaaaatttcatttgatgcaagacttaaagaaatttaactgctagaggtttttttctaatatcaaacaggaattggtgttatttcagttttttcacattctagatttccttattgtagtatgtatgcagcaattgcctcagcctcatggtgagtcccttttgcgattctataccatctagggcatatctttctcccactgcttctattaacaatcccaggtgtctagtacaggtgtccagtacattggagttagcctgctgccggaattactgaataatttcttgtcagaacaaaagagatggagaggagaaactcaaatttttctattttctttgttttcaacccagtgtttcctctaatttgtatgaggttacttacgtgatctgctttagtcaattttgatcaatgaaatcagtgtttttttgttagaagcctttaaagaagtaaacagatttctttttcctcaattattatttaaagcaaaatgcttttagtctgaccatgtaaataagaccaagcatcgacttttttatagaaaatactattataattcaactgtccaacagtgattctttttcctgtactttctcctaatttactgttattcaatcttttaattgtacattgggaaaatacattattctttttgagtttttttcttgaaaaaaattatttcgttgtccagtttgttttgactcttatcaacaattctgctaattgggtttctttctttttccccttttaaataatttgtactttcaagaatcgtgatagccgggtgcggtggctcacacctgtaatcccagcactttgggatgctgaggcaggtggatcacttgaggtcaggagttcgagaccagcctggccaacgtgacaaaaccacatctctactaaaaatacaaaaattagccaggcgtgatggtgcgcacctgtaatcccatggcgcgcgcctataatcccagctactcaggaggctgaggcatgagaatcacttggacccaggagctggaggctgcagtgagctgagattgtgccactgaacttcagcctgggtgacagagcgagactctgactcaaaaaaaaaaaaaaaagaaagaatcatgatacaattcagtttttggagagtgtttttctacttatgaaataatcaggttccatcttaacttttatggtgtaatcccccacattaatatgttcactgccttcaaataattctataattactaatatttattgaacacttagaatgtatgagtcatatatatgtgtatatatatgtgtatatatatatatatagacctcatttaattattacaacaattctgtgaaacagaatcctaatgaacccccttgatgtctaccttttatacgtgaggaaagtgaagcacagagagcttgaagttaggtagaagaattggaacccaggtttcctagttccagagctggtgctttttacctactgtacttcactcttcctcactgcccacccctctgaagagtgacctacctccccacaccacttgctgtctccaccttccctacctttcatcaactccttgatcctctgtaatctggtttctgcttactctgttttattgtatctgctcttgttaaatttctaattgtggactctggcaggcagtctttcatccatattttttcactttcttatgttggccaccccctcctccttaaatcaattcatttcagtcaatcaattctgtccccacgccttccattcatccatccatccatccatccatccatccatccatccatccatccatccatccatccatcttacttcagtgttcctcaggcacacatccaaacaaccacatcagaaactttttttggacttcctccttaccttctcccacccaatctactctggcaccaggtcccctcagtgtgtcttctaaatgactcatgtctaacttcttcatgcccaccatcactgcctctttaagtaagtataggtgggacattctcttgaattgtgttgtctcccaaatctctttcataactctagcctcactccttccaatccacccttcactttattgccagaaattttctttctaaaataaaaacgttgtatttctttgatcaaaattgtttcttagctccccattgcctacagtataaggaacagtaacaacaacagttataccattaccactcactgatttcttctacatgccaggaattatgcaaagtattttacatagacaatctccttatagattatctctccattatggcacataccacattgctctatttgattgcatgcatatgtcctctcctacagactcccccatataacataaggagtatttttgtgtgtatgttttcagtgcctggaacaaacccattaaatctttgttgaatgaagggtttcttttgttggtgttataagcaactaatttatgtttgtatgatgtggagacttcagaatcttgtagtagaagcaaatagaacccctcaggaaggtacagcaaaggctgtgctggcttgggcagaatactagttctgggtcaagggaagcaaacatcctgttacccagaacagccgcctcttctaagtctttacaaccacatcatcacctaattgtagcagtatttggggaatgggtgaagaagatgactatctctagggtttggttcagtacatacagcctgctactggaagtttcacacctatgtgcaccatatagtttaaggcaaaataaccgtattctgtagtaaatagactcaaaatacgtattgccttcctagctctggattgtctaattctttacggctgactccgtacactaaatggcagtgatttcattgttattattattataaaatggcttgttcttccaagctattatatatttcttaaatgattaacctttacacagccttggtatcccatgtttagcaataaaaattgttcttaattttctttcttgggtttaatttaatttcttatacattaaaatatataaaatttaatttaattcctccatttctgagatgttttaaagggtgttagctgaggttaccaacacttttaggtcatgttaccaataggaatttgacatttatatgaataaaaataatattgtgttacaaaaactaatatagaattgcaagggctatcaacctctatgcttgaggccataaattgattgccagcaggggtcaatcaggaggctctgcattctctgtacagtctccctggggtaaaccattgcagtatttggtgtaccagcagaaagggcagtgtgaatttacaccttcctcaaaacaaattgctgaaatattcacctcttaccagaggtgtggactcatagcacttcttatttaatgcctaacaatagggtccaaggttatttttccagaaataatatcaagccacggaaaataaatgtaataattttgtcaaatgtatgcagtcaggctttgtttggtccactctggtatacttatagagagggtcttatttctggtttttgtgcaggagctcctgtgaaaatgaactaattaggtgctaatttacctaaaacggagtgctaataccgaagttgatttttaaagtacaaatgtggatatgttgctattttcactgatgtctatttatttcatgtcaccttattggaaagtattcttattaaaatgaaattcctttaagtttggaataagcttctgcctgagtaatggaaattataatgagatataaaattgaagcattgcctaccctgttgcaaatattatgacattgggtactgttgataaaattaactattttagatcagaataaacctttattggcctaaaattgaataacacaagtttttatgttattatttgttttctgttattacgtttatgatttttttgttgtagtgtttttctgtgtgaaggtagcttgtgactctttttgttctccacttcctcacaggctatttaaatgaagttgtatcctataaagtaggagtttttttctcgtggtaaaagggaagatatacatggcccaccttgttttacctcctttgctttgtcgtctgtcatacttctcatttgttatttatttaattatttagagacagagtctcgctctgtcacccaggctggaatgtcatggtgagatacgtctccctgcaacctccacctgccacgttcaagcaattctcctgccccagcctcccaaatatctgggattataggcacccgccaccatgcctggctaatttttatatttttagtagagatgaggtttcaccacattggccaggctggtttcaaactcctgacctcaagtaatctgcccaccttggcctcccaaagtgctgggattataggcgtgagccaccagggctggcacctcctcatttgctgttaggtggtgctggtttttttgttttttaagctagctgatttagtctgtcctcaccttgagttactccttttctgtctttcttgctgtcttattttttaagagaaatcatttctacagttgcccatttgttacgacactgcaaatgtatcacttttttttctaattaagatcctgtatggcattctttctactgctgtgtcaggtgctgtgtatagaattagacttcctagaggaattttgtcttgcattaaaaaatagacttgaggctatataacacaaatattagtggtgtcgtctgtgattagatatatgaaatttacataatacctttgtcagaagcctgaggggttcatgcacttgtagcagcagcctgtggttctgctgttgtgaatgatgactgtcttgtatggtgtgcatcaccgtgatttccgaaatttttttcttaattaattggatatatatataggaatcatcatacagcaatagacaaaatagaaccattgaaattcatgcttcaaaatgtttcatatgctcacaagccactaggagatgctaaataacactatggctatttagtttacttttttcaactagcattgaggaaagaaccctagaagttgcttccagcttaatttttaccttttttttttatacagtggccactgtctcttttgtgtctttgttatccaataagtattttatgtccaaagtaaaaatgcttttctaacaccagtgttctaaatgatactgtttaaaagtcctagaagctgtggtgctaaccctattagaaacaaatttttctgtctcccctttttctttcactctttcctccaaaaaaagtaaaaattaagggataagatagtttttgccaatttaattaacatgattatgagcatgtggaattagactgcaacttagaagtcatagtctggcttccttcattttcatttgcttggagaagttatttttttctccctttcacatgtatttaatggcgggggcagtgtctggttttccgtggcaccacctggctgccataaaaggcttgttcactcacaatgttagacagaaatatatgttggttatattagaaatagtcccatatcttcaactacttttagctgtttttgacagaaaggaactctgttagagttcacaggttcacaggtactattacgtacttctgtcttttttattttatttatttatttatttattttgagatagagtttcactcttattgtccaggctggagtgcaatggcactatcttggctcaccacaacctctgcctcccaggttcaagcgattctcctgcctcagcctcctgagtagctgggattacgggcatgcaccaccacgcccagctgattttgtatttttagtagagacggggtttctccatgttggtcaggctggtctcagactccctacctcaggtgatctgcctgccttggcctcccaaagtgctggaattacaggcgtgagccaccgtgcctggccttttttccttttttttttttttttttaagagatagggtctcattatgtttcctaggcttatcttgaactcctgggctcaagcgatccttttgtctcagcctcccaagtagctggcattacagatgtgtgtgtgtgtgccacggtacctgacacaggtactattatgtaagtaagaatgaagagccagagaaagaatgctaaagcaagtatcttatgaacccagccacttagttacagagatactgaagtgaggtactgtcaggattttcttccaagcaagaactgtatgggagtaatcaaaatcacaatactgatgatagaaaatttaatgtagtccagtaattgagagcacaggcatagggccagttaaactgatatacagattagatagatagactaaatcctatctttgtggtatgtggaccaaattacttaacttctcttaccttgatttgcttttctgtaaaaatgaggataattacatcctttctttaaggttttttttgagaattgagataatatgtgttaagatgggcttaatacagtccctggtaggcactccttaaatgattgctgctacttttttatgtattcaaagcaatattaataacaaaacaaccacaatacagaacacaatcaataaatgatacctaaaaaataaagacaagaatttgttgcagattaagtgaaagacagcccatttaatctaaaatgcacacaaaaatatgaaggaaaaaaaacattgaaaatattttattttctttctacagcttttttaataaaatgcccctaagttgaacgtacagttcagtgggcagaactcacccaaaagattgagaaagcagagggtaaatatgtaatagttacatattaattgatatcaactaatgtctctaagaacgatgccatcctttggggttgtcaaagttgaaattaaagatacattttttcaaaaccagagttttcgtcaccatttgtacacctttctttatttacctcacctaaggtagcaccccacacactaattcaacccccatagtgccatccgtccggacatttcagttgcttctctaataaatgtctactttcctgggacaccttatggtccttgttgctggtggttagttttgtatgaagtcattgtctttgaagtgttgttggttgataatgcgtgggaacttatctttcttaaatataatttacctttggctggggtatttaatgtcttaaagcaaaagaagaaacaacagaataggtcaggaactctgaagggccaatgtttgagatcttgttttggaaggaatttcagcaacggtagctgggcagaaggctgacccaccaacatattttagcaaagctacaaggatttggaatgatagtggcccccagcatggcctcctactttgcaggtcccgaggtatgaaattaagttacatttaaaaatcagaattagttctctaatcttcagatagtgttaaaccttaactcattccactgtttggttataaataaataaacataacatttgtcccaagttgttctacaggttcacgcctagccatagagttaactttgagcattatttgcagtgcagggggtaaattatcttcaaaacgctcatggattggctgctgcccagagtcctgagagatgtaatcagtttcagttaattctaaacaatagattgtggcaggaactcagctaagtggcgggttgactgcacccaaactgttgatttaagttgtcaagagagcttgactcatgcttagacttgacaacagtttgggtcagctggcttagctgtaaaccattaccagtaaactctgctccttttgtgtgtgaggagggaagggggatggcccttctggtcacggtctccctccctgagctcactgcagactccacggcctggctgggaggctctttgtgacttttactgtgctcagacttcagtctcttcatccctgtcatgcgcatcagtgggtttctagccacaggcctgaggaactgccaatatagtatgtgctttgtgtactttctattcatttctaacttttgttggtgatgtttaacaggaagtgcgttactattcactgtaccgtaatccatatctgtacagcacttaatgctgttcacagagaactcatattgtccaatatattttaggctagggcagggcaggaattacattgcatcagcattaatcatccttgttaccttttgatgagatcattcaggttaaatactggttggaagagtgatctaaagttgaaggcatgaggataaatgtaggaaaaacattagcagtttgcttaatgtaagttttttttttaagtttgaagataaatgtttctcaattgataattttttttttttaccattagcctttgaacattagtagtaacaatttatttttatttaaagtttgtccacacatgcaaatggaaacatgttaccccttggatactagcttaaatttatttactccgaggtgatttaaagtccacatataggtatgcttgtttcagcaggtcagatttaaggataccttaatttagtgatgaggtactctgaaggtctgaacttgagaaggtgatccaaggtgactataaccttacacttcctgttagtacctggctcagagtctcaggagactttgagggcagtgttttgatatgaattgcctttgtgttctttctgtaaattagtttttggtatggaaagccagaaagctcaagtcctttaagtacataagtcaagcggctttttttttccatacccctgtcaaacattgtacacttatcgctttccttttataattttgaaagtctccaaatcattaaatgatatgcttctcagttgtggatggttccattttctaatgactattttgtcttctagagaatgtctgctaaaattcttcctgatttttattttactttccaatgtggttttcatttatcttagaacagtgtgcaaactttcactgagaatagaaacaataaacagaatggcacaatatatttttatttactatagatcatatccatttagctttttcatggccctttcatcattttctattgtgccattcactttagtgggtacgttagttactcacatggtgtgacctgggaaaggaacattacagttgtttttctttggtttacataatgtcatcaaatgaggggaaactgtccttggctgaagaaagtttcatgaattttaatgtgtaccatttcctttgttattaatttgtaaataaatatatgatagagagtaaaataatgaaagattttggcaattatattttagccaagaaaataatgagaaatacctattttcttgcatctcacattaacatctgttaggttacacttactattatgagatgagggttcactttagagatgagtcaatagtataaatattagaagcaattttctaggacaaagtatagaatggttttataggtgacatgtgcctgtgcaatgttgacctattaatagaatttatttatttatacccatgcacaggaatggaagcatttcacagacagacatgtaagaggttaagatttttaaaaatgcagctgaagaggccaggcatggtggctcacacctgtaatcccagcactttgggaggctgaggcgagcagattgcttgagcccaggaactcaagaccagcctgggcaatgtagtgaaaccccatctcttaaaaaaaaaagaaattggttgaagaaatcaagagaaagggcacaattaatgtaggaaaaatgagatgattacaatgataagattaccatcaaaaatacatgtcctccagcctcatacacttattagacttcatatttcatcacagatttttagaagccaatgcaaaaaagaaaatattatcagtaacatgctttacacagtctataagatagaggtgtcagagacggggaacacagctgttcctgctttgagactggaatggaaaatctgccagtggcctgtcttgtgatacttcatgtcctcatctctgggcacatgggaactgctttcctttcttcctcactgtaagtgagagtgccagatcacagttcaaaaaaagtccaagtacaaagtcttttcccagcatggcttaattcaacaacaaatttagaccagctagaggaattaactgatggaccccacatctttcagccagttatctgctgtttctcatggctatgtttttgataaaatattgggtagcagaaaacttgatattgtattatctgaacagtacttagactaaaaatgtattttgttgcccaataaggacagatccacaggctttaaaaatccacttgtctgatataactgtaattatttcttacgaagttgatgtgaaagaaatcattttaaattttgctctggttaagtgcagattgtacaatcagtcacctcttctccatcctttctcctccccaaaattctctttattttttggactataaaaatgggctaagataatctttcatcagtgtcattcatagtcaaacacactgtttttcttattaaacatacccctctctatatgctttgctgtatgtttcagttagtttttcttaaacactgacatgtctgctctagttttgttgttttggtttggtttggtttagtttatttgtattatatacttaatcaaattttaaagaaatgcaaaagtggatgaatattcctatttttcttcttttagaactttcaggctgtcccacctgacttctctttctgtttggaggcatgtagatttggggttgtttgtttgggggtaggaatgtaataagtagtgaaatgaaggggaacaaaaagaattttaactattattttctccaggccctggaaactgaagttcttagggcacttgagtatttaggtgctctaattattctctttgaaataaatagtagggtggttttataaacctctgctactatttctagctgtaaagaagtttatcaagagaaagaaagcttcattccaaacttctctgacagcttgctaattcatctgcttgcttcttgttggtttatattatcgacatggtacaaccttataggaaaaaaagaatacaatgcatgttaaattttaactacttaaattgttctctaaattcacaactgaacacctcttaatttgtattccatttctcccatcattgttttgaatgaacatttctatgattcagtctggtccatataatttatcattttttagaggttacataacattttattgacattcttttttttgcttactcatttctcgttgttaaacatttggattgttttcagtttctaactatcatgcaaggagtgtggttattagttctttttcctttatttgaggtggagatcatagaagcaagttaaaattaaataaatatatgtaatattgttgctgctaatatattaacattagataatacaaacctggtagagtctggttgtatttttctgttctgtatgttcactgtaagatattttgtatatctttatatattcaaaatattctgtaattttactcattttgtggaattcttctgaaacaggctgtgaaaacatttgatttggagtcaagaaataagtttcttgttgctgtcaattgggaaaacggattttatctctttagcttcactttgagtctcatcttttgaatgagaagactagattaaagaaactctgaggttcacctttgctctaaaatttcatcattttagtaacttgctacatagttttacaattttaaataattatacaggtttattattgcatttttgcttttatgatgttttcgtggctttatctgtaatttaatactgagtcacattcaggagggcaataatcagtgtttttattattatgaaaaaaggcagacttttatgatacattttccaggaattcattgtagagtgtaatggagactgcttgtgtatgaaaccagacacaactgcagtcttaactatgatgttatcagagaaaattgtttcccttccagacacttcaggttgtttggttgtctttatctgttattggacatgactttatgaattattttgtctatttaccataatgactaactgccaagggtgctcagaaacctctcaatgagcctcaaacttccttgtattctctcttcttcttcctccttgtcataaattctcatcacttgacctcttcttattctctaatcttctggcttctacctgccctggacctcatggtcctcccttctagggatgcctttcataatagctttggcattcctttacttctaaacacactcatctcccagccataaccctaccaccagcaccaacagccacccccgccctacctccagattgctaaaaatcctggctgaaggggttgtagtgtttaatctccacagagccctctttgctgttcatcagtctattttccttttcagtacattcttccatattcatattagccatatcaaatcttcttcgtctacttcaagtataatactccaactttacctaacttattctcaggaacaggattggacctcacaagtaccacctcagctctcctccttatcagccccaaaatgcagttatatactggccattgtcttcattcttcctgcctaagaagttgtttctcctgtcttcagtggattgaagtagattctaatggacagtgctatggtttaaatgttcccttcaaaattcatgttgaaatttaattgccattttgatgacatgaagagagagatttaagtgatcacctcttaaagccctcgtgaatggattaatgctgttatcaccagaatgggttagttatcatgggagctcagctcccttttcctgtctcaagtgctcacttgtccttctgccctccaccacaggatgatacagtatgaaagccctcacagatgtgaacgccatgttttggacttcccagtcaccagaactaagagccaaataaacttctgttgtttataaattccccagtctatggtaatctgttacagcagcaggaaacaggctaatataagtggggaggtaagaccaatgagagtaacagatctggagaactgagtgtagatcatgttctggaaaacagaatcatttgggataagagcctgtgcagagtcagccaaaagctttggcccagaaatctgaggtggagctcacttggcccgtggtgctaaggagaaccagagaggaagacataagggtggactaaacacaggaactgaggaggagtcagagaatccaagaacaaggcaggtgggcctaggtactagagaatctgaagaaacctggtgtattagggtcatctgggctgaatggagtcacagtgatgaatggaagcccagggagtctgtcaatactttgtctggaatgttgaaagaaattcctaattggctacttttttctaactctggctcacctcctgcattttcaacaatagtaatagttaacatttaagggttttctctgtgccaagcagtatcttagaaccatatagacattatctcatttgatcttgacaacattcagctagtgtatttattagtctgctcacgctaccataacaaaatgccatagtctgagtggcttaaacaatagaaatatattttctcaccattttagaggctgcaagtcccagatcaggtgccagcagattctgtttctggtcaggtctctgttcctggtttgcagatggctgccttcttcctgtgtcctccactgggcctttcctctgtgtgtgacatggggagagagagctctggtgtctcttcctttccctataaggacaccaattctatcagctcagggctccacccttaagacctcatttaaccttagttacctaaaggtgctatctccaaatacagtcacactggggtattagggcttcaacatgtaaatcttagggggacacaatccattcataacagctagttaggtattatccttaatttgtagattaaaaaatagagacttaaagtggctcaaaggcacataactagttaccaaatgctgctcgaccttataacctgaatgttcaattggtacttcaaattcagattgtctaagatggaaatcatattcccttctccaagcaaacatcacatctttgagacctttttgtttctcttcattgtacttatgctttcaaagtcaccaggcattaaaatttgaagatactgtgcttcgggctattttccttctttctccttacatcaaacatctaactagatgtcattaacctctcttttcttttctttctttcatttttggcagagtctcactctgtttcccaggctggaatgcagtggcacaattatggctcactgtaaccttgacatccccaacctcaggttatcccctcacctcagcctcctgagtagctgggactacagacaggtgccaccacatctggctaattttttattttattttattttttatagagacagggtttctccatgttgcctagcctggtctcaaactcctcctgggctcaagtgatctttccaccttggcctcccaaagtgctgggattacaggcatgagccaccatactggccagctccttctttttgtaatgttgatcaatcccagaatgaaggagagaaaagggaaacaagatgaaaataaaagtagagagagagacttgggagtcagagtaataaaggtggtcttggcaaatgggatctaattaaactaaagaacttctgcacagcaaaagaaactatcatcagagtgaataggcaacctgcagaatgggagaaaatttttgcaatctacttatctggcaaaggtgtaatatctgaaatctacaaggaatttaaacaaatttacaagaaaaaaacaaacccatcagaaagtgggcgaaggatatgagcagacacttctcaaaagaggacatttatacggccagcaaacacatgaaaaaaagctcaacatcactgatcgttagagaaatgcaaatcaaaaccacagtgacatagcatctcacatcagtcaaaaatggcagttattaaaaagtcaagaaacaatagatgctggcgatgctgtggaggaataggaatgcttttacactgttggtgggtatagaagttagttcaaccattgtggaagacaatgtgacgattccttaaggatctagaatcttggatctttgacccagcaatctcattactgggtatatacccaaaggaatataaatcattctactgtaagacaaatggccacatatacttattgcagcactatttacaatagcaaagacatggaaccaacccaaatgcccatcaatgatagactggacaaataaagaaatgtggtacatatacaccatggaatactgtgcagccataaaaaggaatgagatcatgttctttgcagcgacatagatgagattggaagccatcatcctcagcaaactaacacaggaacagaaaaccaaacaccacatgttctcgtaagtggaagttgaacaataagttgaacacatggacacagggagggaaacaacactcaccagggccactggtagtggaggtagtgagcggagggagagcattaggacaaatagctaatgcattcgggacttaaaacctagatgacgggttgataggtgcagcagaccaccatggcacacgtatacctatgtaacaaacctacacgttctgcacttgtatctcagaacttaaaatttaaaaaaaattaaaaagagagatgttcatggaaaagcactgtttgctcagagattttctccaaaacctctgttttagggtttgccttttatgagaagtagtgtatgatatgtgggtttatttccctaacttcaaggttttgtgatggtatcgtcatcaattttccatcaaatctcttctttcgatgctttcttggactcacctgcttctatgtcatgatgaattttatttgtatttctttattttgcagaagggaatgcatgcatatgaggaggaatgttcaaaaagtttaaagggatacattgaaaagtcagtctcttatgccagctgctctttctgggggattttaagaaggggcaggagttgattgattcactcttctggcccattctctcttcattgaagctgacaggggtgctggtgcatgtctctttccctcatttcaaactctgtatttgttttctaatgccatgtaacaaaagtgccaccaatgtagcagcttaaagtaacacaaatatattatctcatggtttctgtggacagaagtttggcactgcatgggtcaaacttctcagagtctcactgggctgaagtcaaggtattggtcggggctgtgctctcatcttgggctcagggtcctctcccaagctcactggttgttgagaaagatcatttccttgcagtgtttgattgaagttcctatattcctgctagctgctggctgggaccattctcagctcctagcagcccattcccatgtgacccccacagatcgtttacaacatgggtgtctgctttcttcgaagcccaccagagcatgtctctctgactttgccttctgcttgcaacggggaaaaacactctgcttttattaaagggttcacctgattaggtcaggcccatcaggaaaaatctccttatcttaatgtccactaatttgggaccttaagtacatctgtaagatcccttcacagcaacacctacattcgggtttggttgaataactgaggcaagatgtctgcctaccaggggctgggagttcggggaccatcttagaattctgcctaccacacactggtttatggtttatcttgagctctgagggccaggcctggcttggataaagtggaaaacaacatcttggaaggtagaagtcgggattgggagtgagtagaactcgatggagttgattgtttccatgatgtaactggcttgtaagtctgccccatgctttagaggtaccctttacttcgtgtgcttttagccccataacaaacccagtctttttcagtgcgttatttgcatgacttttggacttcatttggaaaatgcttcaataccccaaagtttcttgaaggtgtggagtcatctaaccctttattcccccattacctatcctttgtctttgtttgctgaggaccatcctggtttatgcctgttttcctggtgtatttattaatagtacctcactttcattcaacagtgtctgcatttggaggataagtgatatagacacagtatccatgccatttcgactcctgcacgtcctatctttctcagcccccttcccaccatcttaatgctatctatatactgacaaccaacccatggatctttggctcactccaaccagattcctgactcaccccctcctggcccattttgtgcctaagtagtaagtgtggctattttagtttctctatatgttgggattggggtgtctgcgagctttgtatttgtattgaatgttgaagagagctaaaggcaagaagactttttttgtagagatggggtttcaccatgttgcccaggctggtctcaaactcctgggcttgagagattacaaagtgctgggattacagacatgactcactgcacctggctatttcccctttatttctttactccagaaatgttcaaaacagcggaactctgtctatttttatttaaagttacttaattattctcccttccctaatctcccaaatagagctgattataatacctattcttaccagtttgttataaaaattaagtaactttttatataaagtaatgtgctacataacaatatttcagtcaatgacagactgtgtatatgttggtggtcccataagattataatactgtatttttaccataccttttctgtgtttagatgtgtgtagatacacagatacttaccattgcatttcagttgcctgcagtgttcagtatagtaacatgctgcacctgtttgtagcctaggaaccatagcctgtaccatatagcctaggcgtgtggtaggtttatgtatgtacactctgtgatgttcgcacaacagcaaaatcacctaatgacacctgtctcagaaacgtagccccatttaagtgatgcatgactgtatttcaaatagataaataattcctggcccatagtagtcaatttaaaaatgtttgtaaatatttgttgttgaagagtatcactttagagttatgatgtacttttgacatttggctagataggagagaaaggtgcagtccaagtgaggtgaggggatccccaacatctactgtagagaccaacaaagcacgttcgtttgccagttggtaaactggtttggttttagaagaaagtacagttgggaagttgtgaaagaacagcctggataattaggatgaattcagatttttgagggacttagaagttatgcctgtttgtttgtacttggggtagcaaataaataagctgttgcaatattttcccaataggataaggtgatgagaacaatgtaatagtgaccattgatgagatcagcactggcaatggaaataaagaggaagggcaagcataggagacttgctgagatatttcttttttaactagtgcttgactagtgataaaggatggaacagatgagttaatgttgactgaaagtttttttaacctgagtggccagaaaaccgttgatatcatagaagaaaagatacacaaaaccttagaagggagagagtagggttgggtggacatggaggataggctttaaggggacctggagaggaggatgggaaggttaagagaatctaaggagggaaacatatggaatagtttccaaatcagtataaaacccaagctacgggaaaagtgttgcaagagaaggccttggcatactgtcatgttcttggaatgccttccctgcccgcctagctggctacaatcactgctgtatctgtcccagtactcgcttcactatagacgatgtgctttgtgaaagtagtagccatagccctggaagctggcatggcacagggacacagtatatatttctcaaatgaacagttaagaaaaggatggttaacagtggccaatacagtaaataggttaagttgaattaggatagaaaataacattagtggatttgccagtgatgaaatcataatttcatcagcatgctggggcaggagccaggttacagagggtttaccaggaagctaatagtgaggaagcagcagcagcagcagcagcagcagctgtgttctgctcttccaaaagtctgcaaaggaaaatatctggaaccagctagggaaagaggatggtggagttaagcaagataagttgggttgatttgttccttaataaaggtgagcctgaattacaagggaagagtgtgacaatgctatagaaagaagcagggacaaaaacaaagcccgtcaggagttctagaagaatgggatctagctataaagaaaacagcaagattccagttcctcagaatctggaaggaagatacagaagatgaagacaaaactctgctgttgccagatggtctccatcttctcagttaaggagcagtgttatcgtctgtatccacttgttggatctgtaacttttatgagttccatctttacctttgtgccatctttgtcttatcactggagaatccagcaacctttaacgatttttaataaaaaaatttatgaaataaaaattaatgtttggaattacacctgttttgtttcacataagtggccaattaaagcagctcatagatcagctggactgataggtttttattttaccagaaatgagtacagttttctaaagcacacatgtagcttgataataagagtgatctgtacctaataaagctagccaaagcactaaggaaaacattttttctgttaaatcaggccaacacaaactgcctacaagtttaacacatcaaagacttgttcgtgtgaatatagggttagtttagtaccgctgtttgttcatccaagcaaaaaatggataatctagtctcagcaaattatttttgttgctgttacattttttaaaaatcttgctttgacttgataaatacaaagaaatcaaatatgaacaattcacatttgacattttccctttctaaataaaaggcacaaggtgtaaaaattcattttaggaatcttacttgtgaattgtaaactcaattacttttgaaatcttttaatctataaagtttacactgtggtagattgtctacatatctcatgtgaagagataatttttttcctggggtccatttaatgaaatagagcaaaacggagacaccatattaagaactcttgctatggaaatatttattaatttttgtgcatgttgatatttgtgcttgaggttcaatatagattttattttagcatattcttctctatcaacagcaatcttagccaatcacaggaatgtataatcaaatattgctttaagagtaaattcctcagtaaataagattctgaaaccaatgactggagactgggcctgtttaaaaccccctcaaattctctttataggattattcagaataaagcacaggaaatctctgagacaagacacatctagtctcctaccctgctggggatctcctacacactttttactgtttaaaatattatttagtacccatagattttgtttcaagtgtagctcactcatatttgagacaaaaattttccttgtacatgtattttaaactattcaggatcattagaaaacatctaagggtcagcaagcttgtgtgtgtatatgtgtgtttatcaagaaagaaacagatttctacagattttttattgaagaactgtaaaatgtattaatacagtacaattttaaaaatatagatctgttactaagaagaatgaaatgattttatttgggataacagttcacttattgaagttcaaagtttagtgtgccctgtcatcaaaatcagttgtctatattgatttgtcagtgctgatgggtaatgagattttgcatatttcatccttgaaaatgtattttcacacagattcttgctgccaaacactgataccaattcatgatatcagcataacatggttttaactgagcatttagcacttggaaggcatttgcagaattctattagattctacttcctctatttgtcttttatcagatcaatcacttgcaattgacggttagatggaagcgccactcaattgcacagttaaatggatttttaaatattaacatttcctttgcgcttgcatcaagatctgaaaaatgctgttggatatgtggtttgatctcagaaaatatatctgctccaaatttgttttggagtggagagcatgcttaatgctttaactttgacagcatggtaactgcataaagcagcttgacattacttgggatttaaacattagttgttgttaaaaatgattttattgcagtattcattttacataaaagcaaatttttttcatgtaacttcaggttgaacacattaagaaacattaagtccataacagaagctagtttaaaagtgtttgatagtagtggttgaaggcaggtcttcctactgaggaaaaatttcagtctcagccatgagcccaataaatcacagtaaaaccttaccactactaaaccatcaaagtatggtgtggcagagcaagtcaaggtgttaagcttctgtttctgacaaaaatttgtagaagcgatggaagttaagtctttgagaatgaaaccaactgttgatactactggctcaaggacgtatgagattcagatattttccaaagtgtctaccgatgaataacaccatcagcttacattttcacaagcttttgtaaattaatttacttaagtctttttgtgtttcacacgtttttagccaccatcagttgtaacatatagcagattccacttcaggttgtgatgaattagcattttctcaacctctttgaaaatattcttgcctatagttaatctgtgcaaactattcatgaaggctaattttcattcactttaattttggtattcacctcactaataaacaacaacttagcagcgttggtgacatctgtcaattcatcaaagccaaggaaaaatacaaaatcatttgctttgttttctggctgactgttggtgttggtcctgatgtcttcaactaagtaagtatagaacattgagaagggaaaggtagcgagaggagattagacaagaggattcggattatcatgggccttatttgctcatcattgataaagtttggagatgtatcttctagaacattgatttttttggactttttttgtttgtttgcttgttctcattcatgatgttttaatggggggaaaaatctaaaacggaaacccaatatgtgacagttaatctaacactgttttgatggaaaagtcaggaagtagaaggcctagaaccccacaagctccttccctttcccacagaagtttgaaaacaattgtttttagcacagagtgaaaaatagcagttttacagcaggggaatatgtgataagatgtgcttggagcagaatgcctttgcattacaggagaaaggggcaggatgcttgtttgatcaccagttatgtattaaacactgaactattttaaagcaccattttatttaatcttcatgggaacataatatgtattatcaccattttataaaatgaagaaagtacaattcaaatacatagttatgggttggtttatttcttaagttctatcagttacaggatctcaagtctctggaacagtgctgcccaatagagctttctgcagtgatggaaatattctatatctgtgctgtggaacatggtggtgcctagccatatgtggtgtcaaatacctgaaatgtggctagtgcaattgaggaactgaatctttaattttatttgctttcagttcattttaatttaactagccatgtgtagctaccccctactgtattggatagttcagctctagattacagtcattcaaactgattcattctccagtgattctgccttactttgccactaaagattatgcgatttacatttacttaattttgttaaatgtgtcacataaatatttaatttcacctattacagataaaagttgacaatcagatctcaataaatattatttatggaatttgggttttctttcttagaaagggagctaggtaactctttcattgactcattgatgtgtattaagtgcctactttgtgtcaggcacctgagctctggaccctgggaatattgtaacatgaaagacaagcatgattactgtccacaaggaatttaattggcctagtggagaagatttagaaataacaagcagttataatggaacattaaaaaatacaagggagtttggcagcttggaaagaccactgaagatactctaacttgaaggaagctttcccagaggaaaagttctttaagtagaggcctgaacagaggagagtttagctctgtcaaatagatttagaggagcagtaagaaaaatattctgtgtgtggaggccagtaggctagaaggcatggggatttaggaagggaattgaagctcaatggtgctgaactgcaatgtgtgggatatggagcccctgtgatagattctgtaggggtcagacttctgagcacacagcagggctgggggcagaagggaacagaataatcagcacacactataaacctagaagatatttagcattttaacagaaagcaaaaattttttacaaaggtattcagagatctcttttttgtaccaatctgaaattacttttaaaatggtcattccttttttcttaaactgctctaacttatcatagcaagcttgtccagcccacagcccaggacagctttgaatgcagcccaaaacaaatttgtaaactttcttaaaatattatgagtttttttgtgattttttttggggctcatcagctatcattagttaatgtattttatgtatggcccaagacaattcttcttccagtgtggcccagagaagccaaaatattggacaccccttctgtaaaggttaatttgaaagatgaccagtgtataaggcttttttcagttgtccatttatttaatttttacttttctcatctatgaatggagaaaatatcatccagtatatctaacgctgatttcagtaatagcattacctacctaggtgtgaatattcaagagccagtattatatatttattctcacattcagcttcttcattgagagctgagtcttcaaaagctgcctgcacatttattgtgtaagtcaggggtccccaacccccaggacacggactgataccagtccatggcctgttaggatccgggccactcagcaggaggggagcaagcattactgcccaagctccgccttctctcagatcagctgtgttattacattcttacaggagcacgaaccctattgtgaactgcgcatgtgagggatctaggttgcacgttccttatgagaatctaacacctgatgatctgaggcggaacaatttcatcctgaaaccatctccccaaacccccaagtccatggaaaaaatgtcttccaggagaccgattcctggtgctaaaaagtttggggactgctggtataagtagtataaacttaacacatgatgacattgatattaatattaggaatttcactcagcaattagttttcttgtttctgtactgttaacctaatggagaatgggcgagccatcattaccattacctttaacagctcaacagtaagctttattgatagtgagaaccaggataaaaattatcaccttgtggaatatggagaacatttacaggtcagtacctttgcacctgtatttttgttatgtttatttcctcactaaacattgaagaacttcagagttctaaaaggctttgattaattttaacttttggaagcatttctataaaatatggaatcagaacagtatcatgcctgtaagaatcactcaaatttttttttagagaaatgcaaagtatgattgaaacatgggggactgagccatatgaactaatgtcagtcactagacatgccatataattttttctattttgttgtctactattccattttttctgtccatgcatgacagttttaatgttgtatgtggaagagttgtgaaaaattagtgtagtttcagtggctgattttgtgcagtaaacattaagtcagttcccatgaacagccccctggtgcaacccttaataaatgcaaactttatttttagtactgacctttcgtaatgtgagccttgatccattgagatgctgttcacttttgatgcgtctccaaatccctttttttatgcattttaaatcaacacacgcttgctctgaatttatgcatgtggatagacggagatgtaatttaaacacatctgttcaaatatgcatttcagatcaacttggtgccgattctcataatacgatggagtttttgacgagtattatatccctaaagtacacaacagatggtatttattagagactgaatagaaatgaagtttaaggatgttgagctttttgtcttaagtcactcattttttagtcataaaaaataatgggctgaagtcttgtacccctatgataaagctttgtgtgagactattttctttgagatgaatgtctctcagtcaagttgagattaactatatatttttgttgaggagacaccatcaccaggaaaatgtagatcagaaaggggtaaataataggttattaccaattagatactagctacaattaatacttaagttgtgtaaattatggatttaaatagattgaatagcttcactaaaaattcgtatttaatttaggcacatatcaatgagtaatttcaaatttattaaaatattattatacttcagggtcattatttcagtgcctaaaacaatattttaaaagtaatcttcaaagcgaactttttctccccaaatacttatactaagaataaatgacataatatacctatgatatactggcctaaaattagtgtacagaaattaattgcattgaataatgcatagacatgcattgttctttccctaattcctcacttccctctctttttcaagcattgtgcccacatctgcctttttgcccacacctgaagatgagaaactgataagactgcagttgcccatagatagatgataagccctccgggagggaccagtaattgttgcagggttttcagagctgtaagaactagttcttaacacttatttttctctccagagcttataacattgggaaccagttccaaagagctggatcaaggataagaaacaaaatctatatatgcatacctttttcttgcatttggtaggaagctgtgttctcacgtctgcaatcagatgcaagtaaaccagactgagattacttgcaagctattattgacttctatatacaacaccacaaataaatctttttctcatagattagagagagtgcaaaaggaaacaggtgatttgtgaggtaacctgccgttatgttaggcagtaatagaaaacattttaaaatatttgaaataatataattgctttgcactgggaacacgtacatgaataaaagatgttagcaggtgtcctaactagtatggaatctcatgctgttgtatttattggaaatatgcacaccatcagcagatgtaaatttgtaaaaagtaatcgaaacagaagaaggattgaataaaaaaactcaggcttaaatcatgtaattcctttcaaccaaattttcaatgtaataaaatacagtttttgtatcaaattacctttctatcttagattttttttttcaatgttactctgaaaatcttttttttttttttggtattctggattattttctttaaaatgctttcttacacaacatataatacttgcctatcgtatttggtactggataatttgataaaggtttttgtatagcatttaaaatttttgatgaatagggacttaatgcttagtatatctttggactgtaatttatgtggttagtagcatacagtctggtaaaatcacgtaacatcaaataaaagtccaaagaaacatttccttcatgtttcatgtgtatcagtaaaattgcttttgataaaataagttacatggataacacaggtttagctatttacagagattctgttttcaaatctttgatgtgggacttaattttgagggacatattctaagggtagaggatatttggtatgcattttgaatctggtaaataaaaaatagtcatctagaatgcaatttgtttcctggtgaaaatgattttcttcatttctttttgtgctatttttatccctttaaatgttttaactaccagggaaaatttctagttgaggcactcaagtcttaatccattttgagtctgctgcagctccttcccaatgtctcttacaaattaaatacataaatcccatgtattggtcttctatctaatattttaactgtacacccccatttcccacccaccctactccaccaccataccaccattcacccctgtctctgcttctctactaacaaacactgttttagaacctcactgcacatgaagcaccagggaggtaaaagctggatgtaacgtggtccctgccctacctgcacttatagttcatcccttacacaactaacacctctctcgtggcactgggtactctggtagatgtcttggttaacagcctctccttccagtcacgtccaagcttaaaatcctagaatcatattcactccctttttactgtctccacttccttctaccaccacctgcctccactcaagtcagtcacctaatcagccaccatttccaatgattacacctcttcttacactccttcccctacctgccccactgtcactatcctatttgacgccagtactatcttgtattctgtcatgtctgtttcatcgatctcattcttaaggtatttccagaatcatcttactgatgtaccgcttcaaacgttttcctccccacaaaagcctttgatagctccttttccccaaacttctatatgctggtcctaacctccttgttagctatattacgatactcccattcataggccctgcatcctatggtgtttgtgatttgtttctttctacctgaacgcctctgctctggcttttctttctgctgagagtgtataaaaaacagacatagagatagtaatagtacctactttatgggagtgcttaggaggaccacgtgagttcatatatggaaagcacttgaacctcacacaaaatgcatcataaatgtttctcataactcttaatgttattatcactaccacaactaccagttctactgctactgctggtgtacacctaacttagcagtaagtgaggtttttgagggaaggtatagcatcttattgtctttagcacatagcacagttatagagcatagaatgtctgccttccatgatattggttaaattatctgtcagtttaattgatggtgttgattaattgaattttcctcaggaccgaagcccaaagtaagtcttctgcccacatcacatatatgtgtgtgtatgtgtgtgtgtgtttgtgtgtgtgtgtgtgtgtataaatgattcagtatgagggggatctacatgaacatttaaggttctttcagactccaaaaatctatgtgatgctgtttcttcatttccattttactctacttagagatattttgtatgcaacacttgtaaggatactcccaagactactcttctctccttttgcaaaaagcatgctaggcttacttaagaaaaaactcatatcttcatgctttcatcatttgtctctgcacttttatggctctgaaagttattcatcatccctattttagtggcattacatgcctttgcattttgctatctcagagtcatttccttgttactttctgtcgtattcggtttatttatgttaacatcttttaaaagtatcgtcatggaattaaaagcaattcttattcaaggctacctggagaatgtgactttgtctttaggagaaaatcactttgtacaggaagcgtattgtcacagtgtatacagcactgtgtcttggacctttagctgtgatgagatatagtcattagttgtgttttgccaccccagttttcttcatttgcttttctgatcagaaattgattttgttaaatctgtttgctaaaggaaatgtttgctgtaattggagctacatacatagattgaagtggaatataaattctattgatgtcacactttgtttcagttaatttaagcacattctacattaggagggcaatctgtgatcctgttataccatgttgtacccaaaaacctctgtagttgttcctttcatcttttctttttcctccctgtgttattctttgattttatcttctctaaggcccataattctctttactcctcgacatctcctcatcccacccttctctcttgtattgagcctggcacagttggtcacattactgtttacctccactggtggctagaaatcctgtttagccctctattacactctgattctgctttcttgcctcttacttgtaagtattcagttatcattgatgggattgaatcaaattgtctttaactcaagccttcattctaatagactttaccactctgatacctggctggctgatagcatcacacacatttatacacttgcttcttacattggtggtcacagacaaaactttctcctttaccaggttctctaagttcatagcccaaaaccctttcacagatgccaaaattgttattaataatgacattattgttaatttttataaatgctaactttatgttgacatagtataatcattagtatttatagttaataaattattcatgattcttctaaatattcagttgagctggtttgaaaggcagtagttttcaagtcctggtttctctgtgcaaacacttcacttttctaaacctctgtaagctagacatatcccccttccttctcagaaggttgttttgatgtctccgtgtcttaatccgtttgtgctgctgtaaccaaatacctgagactgggcaatttataaactatagaaatttatttctcacagttctagaggctgggaagtctatgatcaaggcaccagcaggttcagtgtcaggagaaggctcattcctcacagatggcactgcccggcttcttcaaatggcagaagggagggagggacaagatagagtgctcccttcagccttgcccttttataaggctctgccttcatgatgtcatcacttcccaaagaccacacctctattaatactatagcattgcggattcagtttcaacatagattttgaatgggacaccatcattcaaaccatagcacttggcgaaatagcacagaaaaaggactatagcatgtgaccttctttgggtttttatggtcattagctagatcggaatgatatagcaggcaggaatactttggtttgccaggaatactcctggcagtgactgttcaggacttggtatcaagcaccgctatagttatctaaataatcctcagattcttttgccaaaaatgatgtaatcagtgctactttctagaccttgcatagtttgggacatgagcatgaggtaaagtgttaaaaattaacaagatgtgtttgttttctccctgactctgagtcaggggctagttgtacctattaacatttctactcccgtgggcacctgtctccctttcccttatttagaggcaccactgaaaatgtgcgtgatgaaatctgaacttgcatgaatatctccttgttggctgctagcacagatgtgttatctggtgaggatttttcctagatttctttcccctggctaaaacagtaaatgcataagtaaagcactaggagtcagagatcctaatcccaggccttttctactgtaaactagctctgtgtccatggacaagtgaccttatcctcagtgcccttgttttttaatatgagagtagcaatctaatgatggaggggtgctgagaaaataacttcatgtgggtatttttatttagcagttgtgtgggtcatccgatggcgtctcaagtcactattcaatgacacctgatagtcattgtttctgagaaagggggccttttggaacaaatgcatctggcactatttaacattcactgccctccatcagtgggaggcagcttattatttcagatcacagacaggaaggattcagatcctgactctgctgcttattgttgtgtgacattgggcagcttacatgacctttctctgtgtccactgccatgtctgtaaactgaggaaaatattgcatatctcactgattactctgaggattaaatgagttgatatatgaaaagagtgccttccacattcttggttcagagaggctggtgttagaagatgccacactattaacctgatagttagctaattcacatgtgactaatgttatttccttccctccgtgactttggggatggttgcagtgtcttgatattctgtaatatagcggctttgttcttaagttttaaagtgtttcttggcatagggtcagctaccaccagcattcaagccatacccagcattccagcactgctgcctgggtatgtaagaagaagggggcagtgggtagtgggctcccttggagccgctgttgtggcaagaaaggactttggtcactcacagtcaggaagagtctaggagtgctttgcaggtcagtgaagcctgtcccaggcagtgctcatggctgtggggagctgtgaagcagccgcagctgacaggccagccaggcgtggcgtgagacacaacggagctgctccttttgaggcagagattttggccaaatgtgtatccaagaggcagtgtcataaaaagtgacagggccttcacataaaagctacaacgtctaacaaacagacacatttcatgtgagtttcacagggaaagggctcttggccacctgccacctccctgccacagcagcccccatagatgctgacagttgagaaccttgtcgagaacatatcatccagttaacaaatgagtttagaatgacgagacttacacccttcaaaaatagacgcaagcaactgtaacctagaattagaatgaaatctccacttcatctcctcctcgtaaaccttgcttcaaccttaaagactccatcttgtacccctttccccaaaattttaactgaaagttgcaaataaattcaagttgttcaaaataagcattgaccaaatgttctgattaattctaaaaatagaattgagcttgaaacaattcttagttaactgattttttgtgttttttttttttaagagatggagtctcaccatgttgcccaggttggccttgaactcctagatccttccgtctcagcctcatgagtagctaggactacaggtgtgtgttactgagccagggaaagagaaagtggaaattcaaagggctttgtagatgacagcttctctttggagaaaggctaggcagatgctgctgagaagccaggcgctggagccaacttgtactgctcacaatgatagtatccccttttcctaaagagaagccatcatttacaaagccttgtgaatctccacttattcctttcccaccagagctaacctctaggacgtaaaggaaaatattgaaattggtattagtcaaaacagggattaatcattgatctctgggtgaataaagcctattgctttattaaattcatgtattcgtcttactgtctgtttttccaagttctcccaagcatttcacctttaagtcagtgggcacttttactgagcctcaactgtctatgtggctgttgcctcattactacagagtgtaggaatgtgaatatgaccccatccttgtccaccaggtgcttatagtttattaggaggcataaggcaagaaaacagatgtaaaaaatgtcaggaagatcataacagggacatcatagaggtacaaaggagggactgtgaatgaattaagatgctgagagaaaatcaagaaaaatttcatcagagaggtggcccagggaatatcagtagtatggataggggattgtacagtaggattgctcagagaggaagtattctgatttcaatgagtagtttggataggggattgtacaatgggattgttcagagagaaagtattctgatttgaatcatatcaatcggaattgggtgataatggaaaggttgattagggctacattttggagagcattgtatgtacccactggccctcaactcaccctggagtgttcctgggagttcttatcaaaaattagagtcgtggacctggttggttagaatctcagcagatgataaataactttggctttgcagaccatgcagtttctgttgcaactgtcacaactacattcaactctgcttttgtagtgaaagcagccataaacagtatgaaatgaatgagtgtagctgtgttccaataaaactttatttacaaaatcagacaacagctggatttggcacatgggttgtagtttgccaacctctgacctgatcggggtaaactgaatgcagggaaaactgaatttaaaacaataaaacacaataagaaaatgttctcaactcataagaaataaagtaattataaatctgggttttgatttaaatgattttataatttctagtccataaatatagcttccggtttctttctcacttgcttgctctgtgtatgtgtgtgtatatatatatttttttccaatttgtatatatccctattcagtattatttatgatgatgctataccaattgcactttaggatgacataaaacttgaaatgtaatgtttctgagtgctattttttggtaacacttccattaaaagtaataatttgcctaatttcttaataatggactggatattagaggcaactgcattttgactgtataattttataaattattcttcccgagacctgatgtttagttaccttccagttatgttttcccattaaagaatgccatgatctgggtttcagtctctaagtggttttttttcaaggtttaattttaaaagatttaagaaacttgcctaactttgtagattttgccctgtcctgatattcatttaattggttctgctaatgtgaaagccctttcaaatatgaaaaaaataaagcaagagagaaaagttgattatttctgtaattggatttttttcttgaataaaatgatttcacccactttatctttctgacttaggggtgggggtggaggatgagctttcttttatattgtagtcagaagcagacagaaaaaggtatagtctgttccaaggtatcagaatggcagatgggtttgggttgtaattaattactgatgctgaatatactctggcccctactttcattctcaaacttaaatttccactgtgtgcaaaataattccatccaggaagaattctaattactttagtaattatcatcttatctctaaatggaattcagacatttgctgtagtttatgaatgttagaaatgtttcatttccttttcaccttgaataacagaaaaatacacattactgaattcagcttcattgaaccttataattcatgttaccatagaaacagaaaaactcatataagaattgtgttagcagtaccatagatagtaaataccttcactttaaccagcaatatcataaaatgattttaataacagatgtgtaaaaattctgtgaaatttaatatggtttcttttaaatactataacaatattatccagtatgcttacttttaatttttaaggcaatatctttggtcttatgtaaggctttgtgcttattccaaaatatttgctatggaatgcaagcatagtgttacaggataaaaaacttatttaacatggtatttatttgatttttagttagcagtgatgattcatttgatgtgtgcttgaagccaaatgatatattctggatttataccaggcttagaaatgtaatggatgacactaaattctttggtgtcatctcatccagttgtctctcatcctttttttttttttttagcctatttgacagccacttttccaagtgtcagaaacaatttttccatacacttgatcagtttttaccacaagtatttaatagttggagtttgttgcattttaaattctcagaatattcagaaatttgcagagcttgagcaaaccatttgccatttattcatatatttcttcctttacttatgtcatacatttgcctagtttactttaaaaaggtaaaattgtaccaaatttaaactgaataacccatctaggtttttatttttgcttattaaaagttttattactttcaaagagaaggaatcattaaaaaactaactgctactaaatttttttagggagataccttgaaaggccatctttgattataaatattatgtataattaatatgttagttgtattttagcatatagattttgcctaatattgattgtaggaattttttttcttggttgccttgcaaaccggggacctctggctggcaacgccctgcctgggccccactcagccacactagtgtgccccagcctgcctgtgttatagcttgtacctgtgtttggcagttcccgagctcttgtactgcgcccaagaaggaggatacactggacattgaagagtgaggaaggcggagagaagtttattgagcagtgaaacagctttcagtcaagagaggacatggggatggtcccctacccaaaggcagaaagttcctttcttgtggctgggtctcgggccttttatggactcagaatggggagtgcttgctgattggtttgtgactatgcaaaaaaggttaaagcaaagacaccactcaaaggtgggcatgacagtgtagaaaaccaattaggaaagggtaggtatatgtagaatagatgaagggtggggatcaatcagaggaaaacgtgccaaacaggaagacacattctcagtccagtccaaggatttaacttgtagcttggctttcaggctttaaactgtcttccagcttggaggtggggtttcactggggacctgcccctatctgcctgtcactatcaatatttgaaaacaatttcttcaaacaagagggtttaaacttctctgtaaaggccagaaatgttataagtctactgtgaaaaagatcacatttattcatttataggaatacatgtatttttattatattcagtttcctgacaaataggatcaaggtttttctgtgcctttttcttagtaatttctagtttattgctttattctcacagaaggtgacctgtgtaaatgtggtctcattaaagtagcagaatgtgaacactgtctggatcacttgagctcaggaattcaggacaagcttgagcaatgtcgtgagatctcattgcaacaaaaaataaacaaaattagccagatgtggtggtgcacacctgtaatctcggctactttgtagtcccagctacttgggaggctgaggcaggaggatcatttgcacccaagagatagaggctgcactaagccaagatcacactactgcactccaacctaggtgacagagtgagaccatgtctcaaaaaaatagtaataataagttgtgttttccgtgaacttatgatcagccagtgcttatggtacatcagtgctgtgagcacatcagtgacataggtaagagataaggactaccctgggtagtgatcagaagcttcagatcagatgcttcctttactatttattgattctgtgatcatgggcaatttactgtacctctttccctaatggcattttccccctttctcatgaaaactggattagaatctatcttatgagaaagttatattaaacaagatgaagttgttaacatattgcctggcacttttattagtattattatgtaatattagtattacataataaatgacagttgttatcatctctctgacaaggttacaataataaagccaatacatattaagcactatatgggaagcaccatcctgagcaattagtacatctattacctcattaatcttatctatgaatacttttactatatccattttatgaaagaagaagtggaagcatctaaggctgaatagtttgcccaagatcatgcagctagttagtggtagaacatcttagttatgcaaggaagttgtttctcccagacagtcatattaaaagaataagaatgaatgcccaggtcacactagactttctttgtcttagtcactcattatggcttttcagccctcatctaaatgttttagtgttttttctgtttttagagcagttaatttaagaaatttttaataaaactatgagaataaatttagagatgctgaaaaaaatctgaaatttatttgaagatgttgaattgtttcttactaaattttctctttcaatataaatagaatgattccctattgttatatgatgttttacttgggaaatagatccatgctttccttcttcaagtccttcatgatttcatgctctgaacgtaattcctttattcctggccttttattttgctgtttgtcccgatttgtctattttttcttattagaggtggagtctagccctgtcacccaggctgaagtgcagtgacacgatcacagctcactgcagcctcaaacttctgggctcaagtggttctcccacctcagtttcctgaatagctgagactatagacacacaccaccacacctggctaatttaaatttttttaattggttgttttttttttttttttgtaaagacagggtcttgctttgttgctcaggctggccatgaactcctggcttcaagtgatcctctttccttggcctccgaaagtgctgggactacaggcatgagctaccacacctggtcctttgtccacatttaattctttgactacacctgtcaaagttgaactgttaagacttcttggccgggtgcagttggctcacacctgtaatctcaggacttttggaggctgaggcaggagtatcacttgaggcttcaagtttgagaccagcctgggcaacaaagcaagactccgtctctacagaaaataaataagagaatataattgagtctcacatagtaagtgctcaataagacttcttagaagagtatgttatggaagattcatgctatctgtcttcagaaaggtatttttttttcattgttaagtctgtaggataatttagagaacacagaatattcattcaatgtaagtgttttgaagatttttagcaaattaatgcagttgtgcaactatcatcacaattcagttttagaatgctttcattctgtcaaaaatttttctaatgtccaattggagccaatccctgcttctactcacagttccagacaagactgatttgctttctgtctattctaagtcgtcttctagatatttcttataaatggaatcacaataagcaatccttcgtgtctttcatttccttaagaatgtttttcagattggttcatgttggtgcatatatcagtagttggctcttttttatttgtaagtaatttccacatatggatatgccacattttgttattcattcaacaattgatagacatttggactgttaccagtttggggcagttatgaagattgctactgtgaaaatccaagtacaggtcttcgtgtgagcttacattttcgtttcccttgggtagacacctagagtagaattgctgggtcacagtaagtgtatgtttaactatttaagaaactgtcagactgttttccaaaatgactgcaccatttaaaattcccaccttcaatgtataagtgcgtcagtttctctatatgcttactaatatctgttattttttttttcagtctttttggtacagccattctactggatgtgtggcattttacatggttttaactttcatttttctgactagtgacaatgttaagcaaattttaatgtacttattagctattcctatatcttcttcagtgaagtgtttgttaaatcttttgcccattgcatcattgtgttgtcttcctgttagtgagtcatagttctcaatatagtttggatacaagtctttttattggatatatgatttgcaaatattttattctactctatgacttctcttttcattttttaacggtatcttttgagtaagtttaatttcttagtttatcaaattttacttttacggattgtgctttcggtgttggcactatcgctaagaaatctttgcctaacctaaggtcacaaagatttcctcccatattttcttctagatgtttaataattctgtatctgacattcagactgtgatgcacattgaaatatttttgtgtataatgtaaggtggagggtttaataatgtgtggggttttttgcatatggtgtctgattgttacagtaccatttattgaaaacgctttgtttcctgccctcattgaattgccttggtaattttgttgaaaactaattacccatatatgatgaattggtatatatttggactctctatttttccattgatgtatccctacactgataaccatactgcgttgattattggagctttatagttagtctttaaaacaggttcatttattccaccagcttttttttcttcaaaattgttctgattatttcaagtcatttgtatttccgcatacattttaagcacagcttgtcattttcagcagaaatacttgctgttattttgataggagttgcattgactctataaatcaatttggagaggcttgccatcttaacaatgctaaattttctaatccatgaaaattatatattcttccatttatttagatcttctttaatttctctcatcaagttttaagatggtttctttaaattctctcagtttatggcatacaacttctacctttctttctcaaacgtattcccaagtagtttttatgctattgtgaatggaattggattcttgatttcattttcaggttgttcattactagtataaaaaatgtaattgatttttatatattgatcttgtatcctacagttttgctaaactcacttattctagtaggctcagtagattctttagattttctacatacaaggtcatgtcacctgcccaaaaaaaaaaaaaattctgtcttttaaacatatatgcctttaatttccattccttgcttttttggactgactagaacctccagtaatatgttgaattgaagaagtgagaacagaaatctttgctttattatcaatcctaatggaaaagcatttttaaaaatcatgaatgggtgtttgatttgtcaaaagttttctgaatctgttaagatcactatgtggtttttattttgtcctttattctttttatatggtacattacattaattgatactcacatgtcaaatcaacctcacatttcttggatttaaaaagtggtcatgatatataatcattttttttaattttgccaggttcagtttgccaatattttgttaagaatttttgtctccttgtttatgagagatattggtctatagtttaattctaatctcttcctctgattttctttaaaaaaaactttttttgtttgttttttctttttttacttttttttaagttctgaggtacatgtgcaggatgtgcaggtttattatgtaggtaaacgtgtgctgtggtgatttactgcacctatcaacccatcacctaggtattaagctcagcatgcattagctattttccctggtactcttccccacctcaacaggctccagtgtgtgttcccctccctgtgtctgtgtgttcacattgttcagctcgcacttataagtgagaacatgtggtgtttagttttctgttcctgcattagtttgctgagaataatggcttctgacaatatccatgtccctgcaaaggacttgatctctttcctttttatggctgtatagtattccatggtgtatatgtaccacattttctttatccagtctatcattgatgggcatttgggttgattccatgtctttgctatggtgaatagtgctgcaatgaacatacgtttgcatgtatctttataataggatcatttatattcttttgggtatataccaagaaatgggattgctgggtcaaatggtatttctggtcctaggtctttgaggaattgccacactgtcttccacaatgcttgaactaatttacatccccaccaacagtgtaaaagcattcgtatttctccacagcctcaccaacatctgttgtttcttgactttttactaattgccattctgactggtgtgagatggtatgtcattgtggttttgatttgcatttctctaatgatccgtgatgttgagctttttttcatgtttgttggccgaatggaatgtttttccatttgtttgtgtcctctcttatttctttgaacggtggtttgtagttctccttgaagaggtccttcactttccttgatagctgtgttcctagatattttgttctctttgaggcaattgtgaatgggtgttcattcatgatttggctctctgcttgtctattgttggtatataggaatgcttgtgatttttgcaccttgattttgtatcctgagactttgctgaaattgtttattgagttaagaggtttttgtgctgagacgatggggttttctagatatgtgatcatatcatctgcaaacagagacagtttgacttcctctcttcctatttaaatacactttattttcttctcttgcctgattttcctggccagaacttccaatactatgttgaacaggagtagcgagagagggcatctttgtcttgtgcccgttttcaaggggaatgcttccagcttttcccattcagtatgatattggctgtgggtttgtcataaatggctcttattattttcaggtctgttccatcaatacctagttaattgagagcttttaacatgaagggatgttgaattttatcaaaggccttttctgcatctattgagaaaatcgtgtggtttttgtctttatttctgtttatgtgatgaatcacatttattgatttgaatatgttgaaccagccttgcgtccagggataaaactgacttgatcatggtgggtaagttttttgatgtgctgctggattttgtttgccagtattttattgaggatttttgcattgatgttcatcagggatagtggcctgaaattttctttttttattgcatcgttgccagattttggtatcaggatgatgctggcctcataaaatgagttagggaggagtccctcctttccagttgtttggaatagtttcagaagaaatgtaccagttcctctttgtacctctggtataattcagctgtaaatccatctggtcctgggctttttttggtgggtaggctgtttactactgcctcaatttcagaactcattattggtctattcagggattcaagttcttccttgttcactcttgggagggtgtatgtgtccaggaatttatccatttcttctagattttctagttcatttgcatagaggtgtttatagtattctctgatggttggttgtatttttttgcagtcagtggtgatatctgctttatcattttttattgtgtctatttgattctcctctcttttctttattagtccagctagtagtctatctattttattttttcaaaaaaaaaaacagctcctggacttgttgattttttttaagggttttttgtgtctctttctccttcagttccactctgagcttggttatttcttgtcttctgctagctttggggtttgtttgctcttggttctctagtttttttagttgtgatgttaagatgttgatttgagatctttctagctttttgatctgggcatttagtgctataaattttcctcttaacactgttagctcatagattctggcatgctgtctctttattctcattagtttcaaagaactttttaatttctaccttaatttcattatttgcccaggagtcattcaggagcaggttgttcagtttccatgtagttgtgtggctttaagtgagtttcttaatcctgggttctaatttgattgtgctgtggtctaagagactgtttgttatgatttctgttcttttgcatttgctaaggaatgttttacttccaattatgtgataaattttagagtaagtgccatgtggcaccaagaagaatgtatattctcgtgtttttgtttggagagttctgtagatatccatcaggtccagctgatccagagctgagtttaaatcctgaatatctttcttaattttctgtctcaatgatctgtctaatattgaaagtggggttttaaagtgtcccgctattattgggtgggagtctaagtctctttgtaggtctctaagaacttgttttatgaatctgagtactcccctattgggtgcatatatatttaggacagtcagcttttcttgttgaattgatccctttaccattatgtaatacccttctttgtctttttttatctttgttggtttaaaatctgttttgtcataaactaggattgcagtccttgctttttgctgctttccatttgctttgtaaattttcttccatccctttattttgagcctatgtgtgtctttgcacatgagatgggtctcttgaatacagcacactgatgggtcttgactctttacccagcttgccattctgtgtcacttaattggggcatttagcccatttacatttaaggctaatattgttatgtttgaatctgatcctgtcatcatgactctaactagttattttgcagacttgtttatgtagttgcttcatagtgtcattggtttttgtacttcagtgtgtttttctaggggctggtagtggttttccctttccatatttagtgcttccttcaggagctgttgcaaggcaggcctggtggtgacaaataccctcacctggaggtgtcaccagtgggggctgcagaacagcaaagatggctgcctgctccttcatcttggacctcttttccagagtgacagcgacctaatgccagggggcatgctcctgtataaggtgtctggtgactcctgttgtgggggtctcacctagtcaggaagcacaggatcggagacctgcttaatgaagcactctggctgccccttggtggagcgggtttgctgcactgagaggaatccccatcatctggagtgcccagcctctaaatagccagcaggcaggaaagactaagtctgctgaaccatggagattgcagctgcccctcccctcagggtctctgtcccagggagatcagagatttctctgtaaaccactggctggagttggtgaaattcccacagggaggccccactcagtgaggaggaatggatcagggtcccacctaaagaagcagtctggccatgatctgccacagccactgtgctgcattgtggggagttcctcctggtccagactgcccagtcttcctagcaccagcaggggaaaacagaagactgatgctgcagttgcagtgatggcagccaccctcacctctaggaactcggtcatcttaggcagtctccagcttgctgctgctggctgcaacctgagcatctgctgaacatctgcacagctctgtgcttgagacccaagatcctggtggcatgggctcacagggggatctactgatccatgggttgcacagattcatggaaaaagcatggtttcctggatggggtagcacaatcactcaccgcctcccttggctgtgagtgagagctccccttgccccatgcagctcccaagtgagccattgctccgccctgcttttcctcactctcagtgggttgcgccaaccacctagtcattcccaattagagaacctggatacctcagctgaaggtgcaggattcactcacccttttcattcttcacggtgggagccactgatggcagctgcttctaattggccatcttggcccctcccctgattttaaaaatatttttaagtaccttttagggtacaagtggtttctggttacatggatgatctatatagggtgaagtctgagattttagtgtacccttcacccaagtagtgaacactgtacctgatgtgtggtttttttatccctcgctcctgtcccaccctcccccttctgagtcttcactgttcattattctattctgtctgcctttgtgtacccatagcttagctcctacttatttataagtgagaacatacagtatttgccttcctctggtttttgtaacagggtaatgctggactcttaaaagagtttctttctcatctatctttgaaatagtttccatagaattgattttatcattctttaaatgtttggtagaattcaccatgaaaccatatagtcttgggtggttttgttttgtgttgttttgtttgggtggcaagattttaaattacaagtttttgtaatagataaaagaatattcaggtttttggtttcttcttgagtccattttcataatttatatctttcaaagaatttgcccattttatctaagttgggagtttactggcataaggttcatagtattctttgtatccttttactgttggtagcatctgtagtgatgtcccatccttcatgcctaaagctggtcatctgtatcttcttttcttttctcagcctaactagtacattactaattgtattgacttttttcaaagatgtactttttacttttattgatttttctctattttctatttcattgatttcttattttacctttattattttctttatttgtcttttcatttgattttttctctttgttagcttcttgaagtggaagcttagatttttatatctaacacagaaattaaaatctataaatttttctctaagcactgctttagttgcatatcatatatttagatgtgttatgatttcattttcattcagttcaagatatttttctcccctacctacctcattttttccccaaaagtattgaatatttgtcctagaataaacctccacaggataagaattatttattttaatcatgtgttttgtttatgtctataattttggtaggtctagtcctttgctgatcatttttctctttgtcttttgagatgattagtatgtgtattagtcctactttattcacatgtagaatttgaagctcacaatttattgatctaaggaatgaagtagaattattattttccatatttttgccagtgaaacaccaaatggcaagtaaaaatcttgagatgaatgtttaaagtgtggggtgtgtatatgtttgtatttttattcaaggtgaaataattaacttttaaaatatttatggctttcttaaattacaggctagagccaacaaatagtttgcctgttccttacatgtccctgatatatctttacaagtaatcatagcactgcttctgacaaggtcagatgcataattcgaacctttcttactccattcccaagctatttaataagcccattttgccagtaaatataggagagaaaaaataatgggccaaaattttcctgttgtttaacctaaatgaatattttcattttcatcttcctttcagaattattttctaatactagtatgaaaacatacataaagttcctaaaattgaataacatattacttagtatttacatacattacacacagcttaaataagtttgtggaaatgattattttaaaaattttagtattttgaaaattcatgtcatctcaaaaatagcttttacccagaattagcatcttaaatatttggattaatattctgttttataccccttataatattctcctagccatttaaatcatattctagtaatttagaatttgttccacttcaaacttctttgattttctcatactaaagagaattatttactaggcaaatcaacagtgtaaatgagatttcagttggttcacctaaagagtcaaattattttcaagaatgtaagtaggatcatttgcgtatataaaattaatgtatagatccgcctcatctcacattaaagtgcagtctctacttaaaaaacattttataagcaatcagtttgtattcttatatactttgaaaccattcaactgcttttacttttcaatattgactagtataagttgctattcacagtggcctgcctcctcccttgctatcaggcaactttttgtttaccttgccaaatatatccatgcattgaaaatccctttccctaacatttactatgacttctttaaaggtttctcttttgtcactatgacccttaaggccaaagtaagcaggtgttgcataacagtgggttcaaccataatgtatcaagaaggatagagggaaaatcagtaaggtactttcctgtgggaataccccataatctagtgccaaatttattctaattcatagctgaggacaataacctttgtttttacagtatttcccatgcagtttctaagatttatttttaaaaattttctaggagagatggactattctctattatgatctgctgtgatccataacttttatttttagctgtagaccttttgataagaattattgaaaaggcaagtataaaactagctagctggaaagctattctacatgctttagtctacaaaaatggtctttttatttatagcttacatgtaaaatcatatgatatttgtgatttttcaaatgtaattttgataattacctttaaagaaaaaaatatgtttatatcacaataaaaagtttaaatttttcttcaaatgtactgttttattcttctgtgtggatattgtctctttttctatttatcatcatggagaaaagttccagtccttggaatttatcttactaactaaagttcagcccagtaactagctaggtgagaccaagaataaattaggaacaaaatattttaaaaaatagatttgtcatgcttctttcacactgggtgttaagtagtgtgtgaagaaaatatggaaagctgttgttttatgaaactatattaggaatataataatttgactgtcctcattggtatgtcccttgttccctcttatgcccccaaatatctcatatatcttaatttgataaactgttttcattctttcatgtagaactgttttttgtttgtttgtttgtttgttttttgagacgaagtcttgttctgtcacccagactggagtgcagtggcgcgatgtcggctcactgcaacctccacctcccgggttcaagcaattctcctgcctcagccacccgaagagctgggattacaggcacctgccaccacacccagctaatttttgtatttttagtagagacagggtttcaccatgttggccaggctggtctcgaactcctgacctcaggtgatccacccaccttggcctcccagagtgctgggattacaggcatgatccactacatctggccagaactgtttaaatgataggaaagttgatattctatgttttgacattggagccattttccctattgtttatggactcagagtaatactggatttttaaataagttaatgtaattctgttattgttatactattaaaatagaacaacgtctgtgccatatttatggaggcactaaatggccacaaggaaatgacttccaagatgccaacatttgggcctatcaaaaacaaaggcagcttgctaccttatcgctgaatgataaaaagattttaatgctttgctcttaaatgtaaaagaacagcaagaattgttctttagtggtggaaagtctcaaccgtgaatgagagtaatcaacagacaaattgcagtgaacagaagaaaaattacaaaaacctttaattgacatcctcagataaataagaaaagatattgtgtccctaaacaagatactgtgaaaaggaaaattgagaaagagctctgagaaatgtaaatagtaatattgaattaattttttttgcaataaaatagttggaaggtatgctgaagtaaaatttccagaaaataaaagggcagagatgaaagagagaaaaagctaagagatcaacccagtggtttcaacattcaaaagaaaggagtccctgagagaaaaattattaaagaaataatatcagaaaacttcctcaacctaaagcccatgagtctccagactgtaccttgtacaaagatttaaagacccaatccaaggcatattatcacattgagcataaagttaatatcttaaaagcttctaaaaagagaatggtgtgggcacatttaaagaagtgcgcatccaagttaatccagacatcccattagcaattttttcagcttaaaaaaagaggaacaatgcaaaatttgtatggataatactttttgacttggagtgctacacacaaccaaatgtcggtcagttgcgtggcctaagaccacgcatgcagagacaacaacaaaatttccctggtatctttctgatgaagcttctgaaagaaagcacacccctacagaatgagggagctaatcaagaattaagaagacttaggatccgggaaaaaaagattattgaaaaaaggataccaagaagcaacattcaaagatgataaccagttcactataaaagcaacacacacctgaaaggagtggcatttccagaaaaagaaaaggggactggtacattatacaatatgtcaaaggtttagaaaacagtattgatttttgatagccctaatggagtctggaaaacatcaacataggtatatagaacattaagctaatttttttaaaaagagaagcaattattaactctaggaaaaattacacattgtggaaaaacaaaactgaatagtatatcaattggctctacagtgaaagttatctttgcaattgtaccaatggaagtactgtgttaactaggagttgttcattgatttctttgggagggtaaggatagagtagttcaagagttaaagcctcatttaccataatagagaagttagtaacttattgcctaaaaattagtaaatctagaaatggcagaattagcatctatttttaaatatagaggaaagaacaaagaaccatttaaaagaatttaagatgggtttccctggaaatggcaggcagccaactgtttttcattttaaacttttggtatttaggactctttgaaactatttgcacgtgtgctttttataaaaataaattttaattaccataaaattgtatttaaaatgtcagggaaatagaataattatggcttatagtcaagtttttacatttttgtcttgttattttctagagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtggtaagatctttttcttgtaaggtattgttttttgccagtagctatagaaatgcagctgtgttgcctaccttcacacaacttgctcatgttataacccttaaattacaaaatatggagagatttccaagttggggtcaggggccagggggccgtggatgagttaaatgaccttaggcaactaaaatataatcacctttttcttcttttgaacagtaaaattcagatgacttggggaaaaaaatttttaattagtatctagtatttacctgtgtgtagaagataaacttttggatgtttcaaaataaggcaatatttaaatatttgtgtataaatgaggcttcatttttaccccactttttaagagactcttttcatagtttgttattgattgggatccccctagttttgctgcttttctattggatagatttgatactatctttctacctttttttttttttcagttttttcacaacgagcctcaatttaattttatcctttcatgttcacagatacagtagaattagatgactcataatgaatgtgaataagtttggaatcaagtaaaggcaaaatgtttcccagaatgccccagaaattaagggtctcaaaacaaatatctactttctagattcattggctgaatacgggcaaatgtaaaataagcctgaagagcaagtagaaatttaagtgaaaattttctactttgtttctaataactattaggttggtgcaaaagtaattgcggtttttgcctttaattaccgcaattacttttgcactaacctaaattttaaaaaattatgccctgtcattaatttgcctcaaatgtttttatgaataaatatgcaaagaaataatccagagcttgttactgtttttctgttatagcgtaagtgaatatcaaacacaacatatatattctttcaatatttggttgaaaaatagatgtatattagttaaagtctgttttttccaaaatcaaaagtgaatatcataaaaccaaaatgaagagcattatttgttttccccaaattttcctcatcttaatttacaactttctgtctatacaagggtaagaaaatattttgcaggtggaccatttaattttctttctaatctaatcaatgaaaaaaaagcagattgtaacaccacaaatcgttaacttcccacaaacataaaaagatgccaaattaattcattttcttctatatcacaagtatatattattgagggataacttacatacagcaaaattcactctttttggtgtacagttctatgacttctagcaaatgcatatagtagtgcaacctactacatgacaatcaagatatagaacaattccattagccccctcaagattcctttttacccttttgttttgttctgttttgttttgttttgctttcagacagggtatcgctctgttgcccaggctggagtgcagtgctgcaatcttggctcactgtagccccaacctcctgggctcaagcagtccttccacctcagcatctcaagtagctgggactacaggtgggtgccaccatgcccagctcattttgttttttagttttcatagagacagggtcctactatgtggcccaggttggtctcgaactcctggactcaagcgatcctcccatgttggtctccgaaagtgccagtattacaggtgtgagccactgcacccagctgatccttcttacccttttttgtaatcatcttctccctccattcacacccagttcctgacaactactgatctgttttctgttctcatagttcaatctattctttttttaaactttacttcttctttgctaaaaaagcttttgtactgtacctacagaaaagtatatggctgtgcacttttgtaaagtgaatacttccttataactaccagtcagatcaagaaattgaacatcaccaagtaccacacaggtccctgtcatgtcctccatttactgtcctctccccctcctcaaaggaagccaccatgccttattctgacaccacaggatagttttacccattattattctggatataaatgtaagaattcatgtttgagtgcttggattttgggtttttggggatttgtttgtttttgcataacattatgttggcgaactaatctgtttttaaagtagctgtagttcatccattgttattgccaggcagtgttctacagcatgcgtatatatatcacagtttattcatcctattgattattagccgggcgtggtggtgggcgcctgtagtctcagctattcgggaggctgaggcagaagaatggcgtgaacctgggaggtggagcttgcagtgagctgagatggttccactgcagcactccagcctgggcgacagagcaagacttgggtattttcaaaatcccaatattagtattgcagcaaatacagctgacagggttcttcttgtttttttcttttgttccacttgtgtgtaaacttttccactggggggtctggctaggagtgtaatcgctgagtcataggaaatgaaattgatctgctttactagataactgccaaatagtttccccaaatagttgaataaatttgcaatcccaacaacaatatataaaaatggtagaagctccatattcttaccagctcttggtattgttacattcttaatgttagccattctggtgggaatgtaacttaattttaattgtagttttatattttcctgttaattaaccattttgagtgtcttttatatgtttattagctatttgggtgtctttcttcatgaattacctgttcaaatcttttgcccatctacctgttggtttaccagttggatttacaacccgcccttacccccaatttataggagttatttacgtattctggctacagctccttggcaggtcatggtaatttaaatatcttcttccattctgtaacctaccttttctcttcatggtgccttttgaagaacagacgttcttcattttaatgtagaatttatcaattttttttttatgttagtgctttttgtgtcctcttaagaaatgtttaccttctccacaccatcataaagatacccctcaatgtactgttctagaaattttatcattttgccttttacctttaaatctgcagtccaattggaatttattttaatttaaggtatgaggtgtgtttgggtttcaggggaagttcacgtttgttttgggtttttttgcctcggaagctatccatttgagtcaatgcagtttattgaaaatatcattcttgtctcactcgcctgcctggtcacctttattataaatcacatgtatgtacatgtgtgggtctgtcctgggcatctattctgttcctttggtctgtttgtcagtctttccacccatacacaggttaactaccatagctttatagtaagtcttgatattggcaatgtaagtatttcaatgtcgtatttttcttgaaattgccctaactattgttgttcctttgtttttgtaaatttgtcaagtttcaccaaaaatcctgctggaattttgattaagatcatattgattttataggtcatttgggggaaactgatgttgttataatatcaagtttctgtccttaaatgaagtatatgtctccatttattttgatcttctctaatttctatcgataatgttttataattctctgtatatgtcttacatatcattttattaaatatgttcctacatgtgtgtttccattgatactattgaaatgattttcatttttgttgctacttagaaataaagttgattaaaatatatttattttgcccaactaattcacttattaattctaatagtgtttctgtagggtatttttttagattttcttagtatacagttatgtcatctgatagtcatagttttaatttttccattccaattctcatgacttttatttccttttcttatcttactatactggcaagaatgttcagtacactgagtagaattgggcatctttctcttcttcccaagctcaaggggagagttttcagaattttaccattaaatgtaaaagttagctgtagctttggaattagtaaagttcctttctattcctatttttccctgtgtctgtgtgtgtgttttaatcatgaatagagttgaactttatcatatgcttttttgtctattgaaataatatgatttgttttttgttctaagtctctgttaatattataacctacattgaatggttttcaaatattaaattaaccttgcattcctgtaataagctttacttggttgtgatatattgctattgataaaatatttctgttgtcttggttatatttcatgaaggttttgcatttttgttcatggaagacattgatctgtagttttcttgtaatgtcttcttaattttgttatcagagtagcattggcctcatagaattagttgagaaatcttccttcctctacatttttctggaagagtttgtatagaagtaaagtatttctttttaaaatatttgacagaattgcccaataaaatcccccagattttctttcttttttttttttttttttttttttttttttaaaacagagccttgctctgtcacccaggctggagtgctgcagtggcgccatctcagctcactgcaagctccgcctcccgggttcacgccattcttctgcctcagcctcccaaatagctgggactacaggcgcccgccaccacgcccggctaatttttttgtatttttagtagagtcgaggtttcaccgtgttaaccaggatggtctcgatctcctgaccttgtgatccacccgcctcagcctcccaaagtgctgggattacaggcatgagccaggtcccccagattttctcatcctcctcacccccaggttacacaccctttctaatctctgggactgtgaatttgatatttgctgtacttgctgatcgtttggttccactctgtgtagttatttttcccttttcctgaaagatagcacatgtgtacagctgaataattttctcggcctgatcctgccataagaatgttaagaatcctatggcctctttttattttgtactgtctctgtcccttttagtctacactggcagtgtgaattttttgtttgtttatttggttttggtttgtttgggcttttttctttttgtttctctcttttttttttggctcagttttctcaggaattttgtgggtcttccctggatttcactggaacttactccattagataaatgttatatccacagatctttatgagatcatccctgctctaccttagcctcttgctgagagtacttttctttgtatttatcctgcttgaggattcttggtgttttttcgccctgtgtcctcatttttttcagaaggtttggaaaccttagccattctttcttcagatatatattctactctcttctctcttcccctgtgatttcagttacatgtgctagatattttcttttgttccccaatatctgatatattctttgctatactttgtgcactttgttctgtgtttctgtctggatatttcctctttatctgtttcctatttccttggtattcgtaactgtccctgggccaacatccacagaaattgtagtccctgaacagcagtgttggcagcagctgtgaggctgctggaaatgcagactctcaggccccaccctagacctgttcagtcaccgtctgcatctccaggtgatttgtgtatacattaaaatttgtgaagcactgatcttgcttactaatcctttcttcatttgtttttaatctgctgtcaaacccatctatgggatttctaattttagttaatgtgttttttaattctagaattatagtttgaattttcatagatttccatgttctaattaaattattcatattttcctttatagtttttaaacatttatatggtttggctttgtgtcctcacccaaatctcatcttgaattgtaatccccacgtgtcaggggagagacctggtgggaggtgattggatcatgggggcagattcccccatgctgttttcatgatagtgagtgagttctcacaagatctgatggttttataaggggctcttccctcttgactctcctctctcctgccaccttgtgaagggggtgcctgctgccccttccaccgtgattgtaaatttcctgaggcctccccagccatgcggaactgtgagccaattaaacctcttttctttataatttacccagtctcaggcatttctttatagcagtgtgaaaacagactaatacaaacatattacttagttatcttaaagtccattccaaaatctccagtatttggatctcatattggttcatttctgctttttagttttgttttttcttgattctggtcgtttgtctttttctccatgtacctagtatttttttctttttttgaatggtggccattgtttattttttaaaaacctgtagattctaggctatcatgtatcttcctccagggaggattttattttgcttctgccaggtgctaaggtaagaactgattattttaatctgactgagatggatttttgagactgtttttcactctttctgatgactgctttatttctgcctgcccttacttttgaatgcagccagttgtgtgctagtgtttaacaagtgactctcgggagaaagagttctgatctgtagcatttgccagtttccatagtgtgaatacttccactgttgccaatttcagattaccaatgttacatcactgaagatggcactgggaagcgatacacacagccagcttttgtgaactggtacacgccacattaacgtaccacctagtgtagttcttctagtacccagctgaaattctatggtgattttaccaggactttttctttatggcagatcttcaactctaatttttgtatctcacgctcatgagaatgcatcaggctctgcgtatttacttcgcctcttagattttgtttggctgttcagcctcccaggcactacttaacattgataaatgtctagaaggaaaaagtgactccaaatattgagctgtcctccacgggcttgtcttctttctgggagcttgatctctcacttccttggtagctttttcatgtttaaatagtacagattgtacattttattcacctttttaattgttcttggcaagaacattggtctgatactagctagttagccagaagcagaactcattgcataaaatcagcttttaaatgcctttttttcggagcttgcagtgagccaagattgtgccattgcactctagcctgggcgactgagcgagactccgtctcaaaaaaaaaaaaaaaaaaaaaaaaaagcctgtttttgtcttgtcttttatcttctaaacgtagcctgttaccatcttcctcacgttttagacttcagtcacccaggcctggaatagagtatctttttttttttttttgtctttattttttaaagcacttttaggttcacagcaacattaagcagaaaataacacatagagttgctatatgtttcctgcccctacacatgcacagcttttcccagtacatttgttacaatcaacgaacctacattacatatcattttcacccaaagtccatagtttacattaggattgatcctaggtggtatacattatatgggttttgacaaatgtgaaatgacaagcatccaccactatagtatcatcagaataattccatttctccaaaatcctgtgttctctgcttgttcatccctctcttccccaaacccctggcaaccactgatctactgcctctaattttgccttttccagaatgtcacatatttggaaacatggagtgtgtagacttttcagattggctttttttgcttagtaatatacatttaagattcctttgaatcttttcacggcctgatagctcattttattttagcactgaataatatttcattgtgtggacgtaacacaatttatccatttacctactgaaggacatgttggttgcttccaagttttggcaattgtgaataaatctgctataaacatccacgtgcaggtttttttgtggacctaagtgttcagctcatttggataaataccaaagaggagcgtgattgctgaattgtatggtaagagtatgtttatagaagtatgtttataaaaaattgccacactgtcttccaaagccactctgccattttgcattcttaccagcaatgaatgagagttccttttgttccatatccttgccaacatccttgccaacatttggtattgtcagcattttggattttggccattgtaacaggtgtgtaatggtatctcactgtagttttaatttgtaattcactaatgacatatggtgttgagtgtcttttcatatacttatttgccatatgtatgttttctttggtgaggtgtctgttcaggtctgttgcccatttttaatcatgcagtttgtttccttattgttgagttataagagttctttgtgtattttgggtaacaattcattattagatgtgtgctttacaaatatatttttccagtctatggcctgttttctcattcgtttgaaacagactaatttttgtttatttattttgtttattattttgtttatttagcacttggaaatttttcaactttccactgcactgcaatctgaaacagtaaacttaggttcagagtgtcctaggccaacttgtgaagctgtttccttgtattattctcagttatactgttctgttctcaagagccaatattctgggattctgcactgttgttcttctcatgcagctctttattaaacctctttgtattaatgtcccaaagcttctataacaaagtaccacaaactagggggcttcaaacaacagaaatgtattatctgacgattctagaggctacaagtacaaagaaaagcctcttctccctcagaatcatgtaccagaatccttcctggcctgtcccagcttctggtgatttcctgatggtctttggtgtttcttggcctgcagctgcatagctctagtctctgactttattgtcacaaggtgtccgtgtatgtctctgtctttacatggctgttttcttaaaaggactaagtcatattggattaggggcccaccctgctcttcatctttactagttatgtctgaaacaagcctatttccacataaggtaacattctgaagtactggggattaggacttcagtatgactttttgtgggggatacaattcaatccacgagactcttctacatccctgtaattatgctctaggtaaaaaccattgcctggaagagtttcttctttataaaatgcagaaactttggtaaaaagaagcaaaaatggtgaaacttgagagatctgcagtcaaacagaagatatatgatgtgcactgagtcttcttggttctcttaaatttactaaaaattaataattgtctactctaccagtcttaggtagtttatgaaactgcttatgaaactagaattcactaaaatataatactattgcaaaatgggtagcagttttttggttttttctttcttaaaaatttattatttttttaaaatttcaataactttaggagtacacatggtttgtggttatatggatggattgtatagtggtgaagtctgaggttttagtgcacccatcatgtgagtagtgtacattgtacccaaaatgtagtggtgttttttttttaatccttcacctactcctacctccccacttctgagtctccaaagcctatttccttgccaaaagaataatcagtgaacatatgtacaattattgtgtgccaattgtaaattttttaaaaatcaataatgaaagtagatgctaacccattattagaagaagagtacaatacaataccagttgctttcaaataatatctttttgttttggctttagaatgcctcttagtgaagatatactattttctgagatacgttttatttctgctaacaacaagtcccaaaaaatgttcttcccctgtagatgacataaggataagtatactctccccgtcatatttacttttacataaatattagcattaatataaataaatttcagtgttttaatctattatggcagagctctaataaatgaactaaattgtttgtattcttaattatttaaatcccaaatggataagacaccctttagttgaattttgtatttgtatagggggagagatgaattcttcgccttgattgcctactgaaaaaaaagagtataatcctcttaactttataatgaaaataaattagacaatatattttcatgaacaggataaactaaaatttattttttttagcttttacaagactataatatataagcgatttaataatgaaatcacctaagccaaatgagagcgactagatttttagatgaaaggtcagatttgcaagttcatattttctgttccattaagtcttccttcattagtcttcattcatttgaagtaattccagtagtatttttaaattgtggctgagattcttggtctgcctaggaaaggtcacctaagtttaaaaagtcttttgatcctcggcggtcaattccagactttgctttttagaaaatattgatgatgaataatgaaattattgtgaaatctttatattaggagtcttatgacttgaaaaaaacaattagatggcaagagtggctgttagaatgtttatatagctttaagatgttaaattgtgatacatctacctacttgcttgtcttacatgttggaaccagagagtaaaggcaatatctttgattatatgtcctcataaaagaatcatagttcacttacctgcagtttctagaacttttacccttaagaaagaatgtaagggagtgtttctaagagggctggagggacattcttgtgggggttagagacagctttgccaaaacggtctctggcagattttccttgtgaggaattacattgttgctgtgggtgttcataccaaggcagggtgaccacttggaacagatattgaataaagaatattcttaaatcatatatagaagcttgctcaatgacatacagtgactctcccaaatctagctgccagtgggtcaaggaatattttatttttcacacacacacagacacgtgagtgcgcacatgtacatatgtccgagaaacatagcatataaaagagctttgtcactttctttaaatgcctttaaacctttttgtttctgagtgtaatccttacgtttaacaactcagtgttttaaagaatatcaggttgccttaatggaaggaatactgaatcttttagcttactcgataacagaattacattatttactcagtgtcagattttttaattaaatttgttttcttggaggaaagagaaaaaatattttcaagaatttttatactctggattgttaagtaccttttattctaaattgattcccaaacatacccatagggaagacccttttctcaagaactttttcattttaacttctcttttttagaaagactatcttggcattcttattcttatgcaacttaattgtacttgatcccttccagttgatcttttgaagtcctttcttctggacacatcatttttgtttttacttccattttcgatggagtttttagcctgcccataattttgttgtatctggatttcagcagatcatttaacagagctttttataatgactctatactagagagaagtatgagctagattataatagaaagatagttgagagcctcctactttgtgtgggtttttatacagaggatatttatttaacataaacttaatgatcccaaagacttcttgaaatgcctaataatctttgatttttctattagacaattttaaggccacttttcaacctatatatatagaaagatttaggtgctttctttttctagatggttggtgtaaatatgttatctacatttcccattctttcaccttctattttattatgaatctaatgactttttgtttgtacaattggttgatcaaatcttcttgaattcaaataggaatactattaaattcattgttataggggctcaaatggcagcaatgagacctaatatggtaggcagagtaacgggtcctcaaagatatccatgtcctaatcccgaaacttgtgaatatgttaccttgcatggtgtattagttcattcttgcactgctataaagaactacctgagactgggtagtttataaagaaaaaaagcttaattgtgctcatggttctgcaggctttacaggcttctgcttttggggtggcttcaggaaacttataatcactgcagaaggcaaaggggaagcaggtacatattcacatggccagcaggaaaggggcagggggaagtgctatacacttttacaacaaccagatcttgtgagaactcgctcgctatcatgagaacagcaagggggaagtctgcccccatgacccagtcacctctcaccaggtcccttcttcaacacagtaattacaattcgacatgagatttgggtggggacacagagccaagccaaaccatatcacatggtgaaaagaactttgcagatgcaattaagttcaagctcttgagatggggaggttttcatggattacctgagtggggtcaatgtaatcacaaggatcctcataaaggggagcaagagggtcccagttagaggagatgtgagggcagaaacaaaggtcagagtgataagctctgaaggtcaaggaagggaccacgggcataaaatgcaggtggcctttagaagctggaaaaggcaagagcagattctcccctagagcctcctgaaggaacacagccctgccaaaacccttgattttaggagactcatttcagatttctcacctccagaactataatataataaatttgtgttttgtggtaatttgttactgcaactatatgaaacttgtacactatggaatattttgatctgagaacattgtctggcttttcgagacagctaaattaattgatctttcagggctttatgttacccagggtttgctgtatcactaggtgacacatgcttattcctagatctgtgaacagttagctagatactaccctacagtcacaataatctttgggcctaatcataataatgatataacaaaagtaagagttaacatttagccatgattatatgtcagatgttgttctgagccctttaatgtatttcattctcacagctctctgccgttagaactgttattattgtcattctgcacatcaggaaactgaggccatgagtgattaactagcccaagatcatacagaggagctcctgcctgcctctccactcctcgatcttgccattccttccaactcactctttgctcccacatctgactgcttgtagttcccagcatacttttatattcatctcccctgcctcagattccttcctcgtcctctcacacagcggggtgcagggtgaggaggagagcttggatcatttgcacttagcatttaagcctctcttcagccttccctgatcatccctggcttggatgatcaccctgttctcctccccacctctttcatgttcccataaattttggtgcttatttataccctgtcacttatgatgtataactggttttgagaaatgtgggggctaatctttctatcatgtgcacctagcacaatacctggcatagagcaggaactcagtatgtgttggattgacagatgctgtaaaattgaattctgagagttgagatgccatcagctgtgagaagtggggggtgcctgtgtgagaggaagaatggctgttacaggggcggcgtgggacagaacctgggcacaaataaaacagggaacattaatgagaataaaattcattcccattggggcggtgagatatatttttgtttgtttgtttgtttttgatgaagtggagaacaatatgcaggaataggttagtgtcaataaatgagtcaggtactataggcaaggcttagattaagatggccatataagccatgttaaatagctttaaactgtcctgtgggcagtagggagctactgagtagtagtgatcttatgtctgttttggaaagctctgtctaggtggcaggggaacagaggaatcagaaagcccattgagaagctactgcaagagatagagttggaaactagtaagtggatttaaagaatctctgtgacttattcctgagactttagatacgtcttcttcttttggactaaatcattccaagtcccagacttagttgcatgtcagcaaattattctgtgttctatggaaaacattaactcatgccacaggcattcactaattgggttttccttgactgtagacttaacagatcaaatattggtaggcaagaacattttacaaggacccttgaacgttgctgaaaatttaaggcaatataaattgattttgccttttgctacagctggtgctgatgacattatcttccctaatggtcatgagattacttcctggaccaggcccaacctcttctactctgaagtagaaacaccaacccctccagccctctttccttgtctgctccctatcttttcccctacttgattttatcttttcccaagctgtttctacttgccagttacaggattggcttttttcttgtggcctctttatctttctttttgtttttgttgttctaagcaccataagataagcttatcaactttgtctctgtgtgtgtgtgtgtgtgtgtgtgtgtgtgtgtttgaaccatgtagaaaactctgggcttgggaacatttgaagaagctggagccctgattggatcattcttttttttttttttctttgaatccttcttaaattgagcacttcccttatatccactgtcacactaacaaaagtaaagaaaaagggggtgctaacatttggaacttggaaacgtgaaaataacaaaaattgttgttaagcctcagctgtgtagagggaagtttgccaatgatacccttgggttgtctaccatcttgaatctgaaatagagaatctaacaaacatgactaatctggagtaaatggaagcagaccttgtcaagatctcatgaaagaaaagactgtttctaagacggaaatgctctccagcagtgtaaacagtgtgcatgggtgtgggctgatgcagtacctctcctcccagggacctgcacaaggagaccagggagataccacagccgagagtgtcaccagtaagaactctattagtttttactgccacaggtaatatcttttttaagagcgtgctcctgattcctctcagtcagaatcatcctttcaggatcccaaccttttccctctgtactatcactgttccccctaattttctaccctctgaacctgacctcttgcctacctgccacagagcactggcccaactttttgtttagccccaatgtgacaatgatgaactaaattccattaccatgtaaatcaactttgtgtagtcagaccaacaggaccagatgtgtacggcacaagtgtagactaacttcgggatggagccgtgtttttgtgggattggtttttacttaagatggtaaagataagaagaaaacccacagattgttggtactaaaagctctttcatgtgactctcctgttaattataagccatttctagaaaaaatcagggatgactgtacttgggaacatataattggtattgggaatcttagcatttcaagttttctaaaataacccaactttaggataatgaggaatcatatatgctttgaagagccttgacttcactgatagcaattttaatttgtgctttgtagtgatagaaaatcattttaaaaaaatgcctgtcaaagaaataaactcaacctgtttcttatgattaattttttgccttccttttggcattcatttttatcctgcttcttttacgaatttgtaattaccaaaagaggaagaagatatgtggttataagttttctctcacatgctgaaaggtggcaggtattagagttgagaaagactgagtgaatttatattaaataaggagaatataaattttatcctttgaaaagtcatctttattatatttcagtctaactttttctccagtggtgattacataccttgttttatacaagtttcagaaaaactgcaaggatctatataataattcttttatgccttttatatgaacttgatttattaaaattgtaatattcaatttgaattcatttttattacattagtaacaactttagaagtgagtagactcttggagtaacttctaaagataaagaaccttataatgatatatctttttttttttttttttgagatggagtctcactctgtcacccaggctagagtgcagtggcgcgatctcatctcactgcaacctccgcctcctaggttcaagcaattctcctgcctcagcctcccaagtagctgggactacaggtgcccgccaccacacctggctaatttttgtatttttttttttagtaaagatggggttttcccatgttggacaggctggtctcaaactcctgacctcatgtaatccacccacctcagcctcccaaagtgctaggattacaggcatgagccactgtgcccagccaatataccttatttgttagccttatttttgttctgtgataagtatggttcattaataactccatatatttataacgttccaaaggacttatacatgtagttccaagtataagagctatgtataatgttaactgtgtattcaggtcaatggaatagatttggtaatctaacatgaaactcttttaaaactcttgccccttgcaatccatttatttcataattaaggacaatataatcaaatatgagcaaataagcattcaaatggacaaaaatgtactgtactagttatgttccatctgggatcttgtaatctaagatgaatgacctggtgctttattttgcttctcataatgacatgccttcagagaagtgtggataagataagaagttagaagggcaggggaagaaaccttccattgtttggatgttaatatgtgccagaaacaaacaaacatagtctatgcttttcatgtactttgtctcctgttattctttcaacaatctttttaggtgtcttttatgacttttactttgcacatgagttagttaactcagctcagagaagttaagttcatttgtctcaggttatgtaactattaagtaaaaagcttgagactgagacttcattctttcttattggtccttgctcttataaacagtaaaataagtactcatccgataaattcaaagtaattttagaacattttgaccaaacaagtgtcagtttttaaagttgtttttctattatgacagtaagtttataggccttagaaaatttttaaacttcttaaaaatgattttgtcttttatagaaaagttgtaagaataatacaaagacctccagtacaagttgagtatcctttatctaagatgattgagaccagaagttttccagatttctgatttttctcagatcttggaataattgcatatatataatgtgatatcttggggatgcgaactaagtctgaacgtgaaattcatttatgtttcttttgtttttttttttttttttgagacagggtctcgttctgttgcccaggctggagtgcagcggcacagtcacggctccctgcaacctcgacctcctgggctcatacagttctcccacctcagcctcccaagtagctgggactacaggcatgcaccaccacacctggttaattttttgtagagacaggatcttgtcatgttgcccggagtggtcgcaaactcctgagctcaagtgatccacttgcttcggcctcccaaaatgctaggattacaggtgtgagccaccatgcccggtctcatttatgtttcatatataccttatacacatagcctagcattaattttatacaatgtttttaataattttgtgcaagaaacaaaggtttgaatgcattttaactgcaactcctcacatgaggtcagatgtggaattttgtggagtcatgttggtgctcaaaagtttcagattttggagcattttggatttctgaattagggatgctcaacctgtataacccttagtgagatgatcagtttttaacattttgctacatttgctttctctttctctgaagagaaagacagatgtagatgtagtcatagatattttgctgctaaacaatttcagaatgggttacagacatcatgtccctttacccccttaatatttagtgtatatttcctaagaatgagtttcttacatgatcacagtactgttatctaaatcaggaaatttaacattgacacagtgctttaatctacagtttatattctaattttgtcaagagccccgacaatatgtatagcaattgctttcccaatagaggagtcagtctaggatcatggcttgcatttagttgttctatttctgtagtctccttgaatctatacagttcctaagccttttttatctttcatgatattgacatttttaagaatactggccagttatttaatggaatgtccctcaatttgagtttgagttttcctcatgattagattcaggttatatgctttgccctcttaagctaaataaaaatgatgtcatatccttctcagaagatctgagaaggtatatgatgtgcttttgccctttatcggcgatgctaaatttgatcacttggttcaggtgttagctggtttgtctagtttcttcactacgtagttatctgtttttggataagaacttgtaatcccaagtattgaataggattgtagaagaaagaaacgggaggccttgaaaactcaaaactctcagtggtttagttcacatttgcaattttatgatgacttgaactgtcatcttatgtagtccacaagatttttcatttctaatagattaagtttaatctattctaaatctttgggttatttctaatagttttaagtccttagactatatttttaaaataaaatattttgaattggatatacagtgacggaggagcaactaaagttggaaaggcagaaatttatttcattgaagtgcctgtttatttacttggcagataatacatgtaaatctttcatcctcagaaactgtgcagatcaaaacctatgtgggttaagagaagctaggtaaattcagttgatgaatttttagtttttagggggaattcgtaggtcataagtgaactatttttcctgaagtactataatactgacttaccaaatctgcctgggtatgacttagtgtcaaaggcatactcttggagtaaaaaatattttccatgtaccttacattcctttactgccattcctctcaatgtttattatcagtgaaatcacaaagtattccctctaactattttctgggttctttgaacttgttattttaggataaacaaatataaagaggtggaagaaaatttccccatgtaaattccagttggttttggaatcaagcacaaaaatatatgactgatatccctggggccgttacaaagttatatgatgcagtagttgatggattccttcccaactaacttgacattaaggcttggcagagagccccgggagccccacaatcccctgggagcagccttcttcattcttctctctaggttaacccagaactagtcaaatactattaaaatgaaaatcagtgtgttctctaagggttgaaaaggttattcatactgataatttgtcaggtacctgaaatcctatcctattaacaaacctaaagactactgtgaacgagtttaatttgattttatcttacattagcagccagagttatccaggggaagattggaagaaggctgtctggtggtgcatctcactagtgtgtagaaactacagcaatctttttgcctgtaatcacccaaaacatggctttcgggagtcatgtaagtctcttgatcattttgaccatcagaactgcatttcttttagaaatcatagtcaaaactgtagttaaaataaaaattgttaatttgcctggtattgagtaagcttctactacatgcaaggaactgtgctgggtaggacactacatctcaagatgactcctgggtgctccttactcaagaggcatgtaatccagaaaggaagaggaagtatggtgctgacagtaccacaggaccgtgtgtctccactgctgtaagagctatacaaagggctgttaaaacttgggggcttgtgagtgggatggtcgaggtcactgttaacaaaaaagtaacttttaagctgagcttttcactacatgaaagatattgggagtgaggtatgagatgtttttagaaagtgatcgcagtacagttgtaaaatccagggtttctagtgaacaatgagaaagactttttaccaggtgctttgggctccatcaagagaattcaactgtataatcctcctggatctacagccgcattggcccttgggaattttcctagataataaactgagccatcagaagtatgacatctgtactcagtaggcaaggagtgacgcaatctaagcagtgctgtagaaagatgaaattagtaaaaatatgctaattgcatcagagtggagaaaggctgcaggcaggaattaagacggtaatgaaacagtgttgttatgaagtctaagagtctgtgccttgatgagactatgagggtagtcagaaaggcaagagaagttgaaggaagaatctctatgacttgtacactggataatactggtagcttacatagaccttgtgtagtgcttgccgccttgcactgttttggtgttttatatatgttgtttcatttaatcttcatgccaaccctgtgggtaatgattgtttttatccccactttacataagaggaaactgaggcacaaagagtataacttgctcaaagtgacacaattaatggtggacttaggattcaaaaccaagaattctgcttccatactctgcttcttaaatattgtatctataataaattatagtggcaagggagaaagaaaattagtgcctaaaataaagttctgagaaacttaattaaaatatagactcctcaatttctattttaaatctataggattttagagccaaaattttactcatttaaagacaaaattcttttaactggcgctacaacttaaagacaaattccatgttcatagaggtttgaggagatagaatgacttaccaaatgcctgatccatgccagcgcctaggtgggtgaactagtgggagccataggcgaacaccgaagtcctggctgttaaaaggggcatctgtagatgtttagggtcagagtctggcactgagtcttctctctgcttgctcctagtagcccctttaccttcctaacagttcccagagaccttttcttttttaaactctatccacctgccatgtttccccccgactgcccaagaccagctttaagtatgatttagggcccaagctccttgttgctttgcccaaactgctttttcactttgactttttttgctattctctgtagaagacaggagaaaaacagaatgaaaactttgaggaaatttacaaaggttaaaaaatatcatagtccctcatttttaattcttaactgtctcactagatctaaatgtcattgtcctaaaatatttttctgggaacatttatgtatcaagcattggttaaaatggcaccccaaacctctgtagcccaataactctcttgtttattaattagtatgatgttccttaacttcaccatatgtatccacccttccattaatttagtgaactcttttccttctgcacccaggcctaagacaacaatgcataaactgcctgaaattgtgagcaagctttgtgccccatactctatccaaagaccgagcaagggatgccagatgtcattggaaatagagtaagatggaaaaaactttaaaatcacagctgctctacgggaggactctatatgggttgtaactgattctttgagaaacatccttgctccttgtaactgccttctaaggagcgggcgcctagttaacttcaagtctttgttttttttggagatagcatctagttctgtctcccaggctggagtgcagtggcacaaacacagctccctgcagcctcaaacttgggctcaaatgatcctccagcctcagcttcctgaagtgctgggattacagacataagccactgctcctggccaacttcaggtctttttatttgccaagtggggtgtacaagctaggacaccactgctgatgtgattatcttctactccgttcctatagtcctcagctgatcctccaaaaacatcagatatttaaagaatattggctttcatggacaccaaataagtagtttctaaaaggctcctgggagagcattttatctaaccctaactcttggtcaatggttcttaacattttttgagaataattttatatatgtgtgtttatataaatgtatatttaattatatttaatatacagatatgcatgcatgcgtgcacacacacacacacatttcctagaaaaaaaacaaatttgtccaaaaatctccgaccggatgattctccgaagttacaccatcaacctgtccctctgaagtcaagccgcttctctctaacatccaactgtggtcctgtctactggctgaatatggggtttttatatgtacaggatgggacgggacagggccatgggttgtttaggaaaaggcagtattcgggcaggaaaacagggatataagttctcattttgggccacagtttcaggctttttagcttgagggtagggttatgccagggacccacatttttctgcctagaatttctctgtcccttgtccctatcaatgggaacaacatagttgaacatctggctagtgactatacttcatataaacctatcagagaaaaacgggttcaaaaacaaagatagtacttccaggatctgggtcaacagagatctgggaaagaagggcaagagaccactgcacaattagttcaattaacctgaaactggagaagacttcatttccccatagaaatagttcataaatagtacatataattgaaaaccaaccataatctacagatatgtagttaaataattggttttcggttgtcattttgggttttctggaagtggaggttctaacaaaatgtaattatttataatgggaaaagatgcagtcttacttcaaccaacttaataaagaacaaagttatggagcatagctagttcaaaagttaggaaatgtccttattatttcctgttgctttcattaattaatacttggcttcacagcactatttttgttttggaattgatagtatttttctacaagtctttaaaattaatatgataggctgggcatggtgactcacacctgtaatcccagcactttgggaggctgaggagggtggatcatttgaggtcaggagttcaagaccagtctggccaatacagtgaaaccccgtctctactaaaaatacaaaaattagccaggtgttatggcaggcgcctgtaatcccagctactcaagagcctgaggtgggagaagcacttgaaactgggaggcagaggttgcattgagccgagatcatgccactgcacccctgcctgggcaacagagcaagactccatctcaaaaaataaataaaataaaattagtatgatatagacaatgttaaatgattctttcccattatctatggataccgggtcatgcactatgcaactttacagtatattatgcttatggaaattaaaatcgtagcatttacttcccttgatttttaaaggaataaagcaaaaaggattaattgacattcttttcaacgtcagttgatggtgagatgaatgttttttaattaccatgccttaaaaaatttacagataggacgggtgtggtggctgatgcccacaatcccagcacttcgggaggctgaggtgggaggattgcttgagcccagaagtttgagaccagcctgggcaacatagtgagacccctgtctctacaaaaaataaaaaaattagccaggtgtggtggtgcacacctgtagtcccagctactcaggaggctgaggcaggaggatcactggagcctaggaggcagaggctgcagtaagctgtgatccttccactacattccagcctgggtaacagagcaagaccctgtctctagaaaaaaaaacaaaagtgcaaatagcaaattaaaataggcatacataataagtatgtgactgtgtagatcctttggattggccagcaaagctctctctgaggaggtgacatctaagttaaatgtgagtaaggagtagccttgtgaagatactaggaaagaggagttgaggctgaggaaatagctacacaaacaccttcaaaaggaaataagcgtggagaaacaaaaaggaacaccttacagcttgaagcgtcatgggtgagaagacttgtaggaaatgaaggaggccaggtggtcaagagtcagatcatggcaagctttataagccaggttaaggtctgtagagcaaagtaagccataaatattaattcctatatagtgagatttgaggacattggattcttgtttgcctctgaaatattgggaatgcatagctacaaccaattaaaataggaagttacgtatgagctgagatcatggtgagaagagaatagcttactcttgttttttattgctatatagcatgcagtgttagggttatcctcattctttgaatttatggagagacatcatctagtcattaatgaagaaagtttttacaagggtgatgtctttgtagctataagtaaatagacacctgttacctttcagctcatgataagataatgaatacaagtgatattattgaacaccacagtcatgttaattggaaaactaattaagaaccttgtatgttgataataggaactaacatttattgagtgattactatatgcagacactgtaccaagcattttattgacatttcatctaatcttcatggcattcctacaatagatggtgtgcatatcaaggctgtaagtgaagcctgtatttaagagccaactgggccaaaagggtaagcacaacttcaacacatttgattgctttccatacctagcatacacagtttcttctgtctttgaacacagttttcataaaatataaaatccattgtgcttagaaaaacaaaacctgagttgtaacattctactttcataattccctttgctgatagagactgatttatggattatggagttatatatttttctacagcctctggaagaaaggaatgacactcatatatatatgaaagtatacataaaacagaatttctagccttatctcaaactttttcactttttatttgttcagggaatactgttagattattatttaccttgttctatatatcaattatttcaaaagagaaattcatgaatgtcatatgtgtatgtgtgaactaagaatatatttgtaagtatactaacaattttttcttttttcttttttttttttttttgagacagagtctcactctgtcacccaggttggaatgcagtggtgcaaaataatggctcactgcagcctcaacctcctgggtcacacgatcctcctgcctcagcctcctaagtagttgggactccaggcaagcaccacaatgcctagctaattttttgtagagacagggtcttacactattgccccagctggtcttaaactcctgggctcaagcagtcttcctgcctctgcctcccgatgtgctgtgactgcaggcatgagtgtactaacaattcttcaaagagtaagtctggtttcagatttagaaggaaagattaagacagatctagtttcattgtctctcaaatcctgccaaaatacatcatagagatttttagtacaggagttattaacccacaaatataaagaggacaggctaggagaggaaaccccacaacaagattgtgacagctggggagcagctagaaattggcaactcacctcaccaacctgaagaaacctaaatgccaacctagcagtggggaaaaaccaaaacccaagttatgaacaaacttgatatataccagagaatcctcaaatggtcaaggaattggctggcacttttgaaagggagaatgaagtaggaaatgagggcactaacataagaaggattgtttaaaactacttaagaagcagcagctggattgccccattccctccccagctcaggcgtacagctcaggcatctcctcactcacaccaacagaagactggaggctcattctttgaggggaaaatgaaaagtctctggactgaagaacctgtggtacagttgagggcaaggggaattcagtgcctatatggatatcaaatgccctctttgttcatttagcagctagaatgctggcagtcacacacgcctttccttgtttgggaaacctgatcagttcaatacttagagatgttgacatcagaggttccataattaaacaattcaaccagatcatcctatattgaggctcatacttgacaaatgcagcaacaggctcagaactttctttttttttttttttttttttttttttttttttttttttttttttttgagacggaggctcgctgtgtcgcccaggctggagtgcagtggcgtgatctcggctcactgcaagctccgcctcccgggttcacgccattctcctgcctcagcctcccgagtagctgggactacaggcgcccgccactacgcctggctcattttttgtatttttagtagagacggggtttcaccatgttagccaggatggtctcgatctcctgacctcgtgatccgcccgcctcggcctcccaaagtcctgggattacaggcgtgagccactgcgcctggccaggctcagaactttcaatcagctttttttttttctgggtcgggggggcggggtttagattaactgattcttttttttttttttttaagttccgggatacatgtgcagaacgtgcaggtttgttacataggtatacatgtgccatggtggtttgctgcacctgtcaacccttcatctaggttttaagccccacaggcattaggtatttgtcctaatgctctccctccttttgccccccactcccctcgacaggccctggtgtgtgttggtcctctccctgtgtccatgtattctcattgttcagctcccacttacgagtgagaacatgtggtgtttggttttctgttcctgttttaatttgctgaggatgatcaatcagctttttaagcctcttactcttaaacataagtagcaagcaaggattaccaaattcctgaggaaagccctaactaacacaaaggacaggaccaaagcaaacagaataggaatggagtgagagagaaaataaaaaataagaaagaaacaggactgggcaggaagacgaaaacttaaaaaaaaaaaaaagaagttactgatattctcagataaatgagagaagatattttattcatgaaataagattgagacatcaaaaaagtgattgggagagcaaaaaataattcttagacattaaaaacatggtagcaaaggtaaaaattcaatagaattggaaggttaaagtagagaaaatctctagaaagtagaaccaaaaaaaaaaataagatgaaaaatagaaggaaaaatatagaaaaatcaaagaacaaatctgggaagggtccaacattcaaataataggaattccaaaacagggtaaacaaagaaaggaagaaattggcaatgaataattcaaggacatttttaatgactgaaggtcatgaattaacagactgaaagcaatccccatggacgcagcattatggatgaaatgtagacccatgccaagacaagagagaaaagccaggtcacattcaaaggaccaggactcaaatttcaaactgacttcaaacttaccaacagcacccagagaagaaatgagtgattccttccctattttgaagaaaaatgcttttcatcctaggattttgtacccaccaaagtattcatcagatttcaggatactcctttctcaggaagcctttccagaattttgggcatcatgaaaacaagagagtaagctaagaaagaagatacgaagatgtgggataaaggaaacagcagactcagcacagatgagaggtgagcgaaatctccaggatgatggtaaatgggacagccatgtatcagagctggagaatagacagattgaaccagaatgtgccagaaaggtccagaggaaacttcttcaagaggatgaaaggatagaatgcttattgtgaatgcacttcttgcgaggtgatttagataagtggaagagaacttggattgaattggtcataaagacatagataaccaactgagctgctgctgctgcttttttttttttttttttttttttttttttttttttttttggagacagggcctctctgtcttccaggctggagtgcagtggcacgatcatggtcatggctcactgcaaccttgaactcccaggctcaagcaatcctcccacctcccaccttagcctcctgagtagctgggtgtgacggtaggtgcaccaccacacctggcttttttttttttttttttgtagagacagggtcttactatcttgtccaggctggtctcaaacttctggcctcaagctatcctcccaccttggcctaccaaagtgctgggactacaggcataagtcactgcacttgtccatcaagcatattttttaaattactaactccagagaaaacaaaatatacagacaagaaaatataattaggtattacttgggtaaaatctgaatagcatgtgtatgatcatgggaagtggaggtaagaaatatatacataaatagagtgggcaggggagggaatgcaagctcatcttccctagagggaagtcaggagatagtatctagtagtaagaaattaccaatagcaaaaatgacatgttacttggcaatatggaggtaaataccaaaagaataaactaaaaagagttgaaggtagttacttctaaggaagcagaaatgggaaagggaagctgggaagctatgtggagctggttggttcttagatcatatacatggataactgattttgaaaaaactgaaaaaataagcagatgctttagggggtttaagattaacagagttgctaaaaacaaacaacatacacaaaaatagacaaactctccaagatagaatcttatttaggtgtacatgaaaataaagagctaaaaagatgctagagctgaaaaagaaaaagaagcaaaaagaacatgtagcttcctctacaataaatagaaagaacttctaaattgccgaggaatttaaaacataaaagtaaagatgtttatggtcttggttgttagtgatagaagaagccaatagatccagacactaggtaaagagatggggtttaatttactaataaaatacacagagcagatacgcaaatcttttaaatgaatgaatgcttattaaaatatagttattacagtttgaaaatataaagcactatctgtgtcaaaagaatgtttggactttgacattgattaaacttactttaagcataactcttttaaaattatcacaatcaggtagttcattgagctcttctaagatactcctgtcgttttacattctaaacatgttgtgtgttaaaccaactggctttttttaaaaacaccttaggatcctcttccaatgaaaaaaacagaaagcatacagtatacgcaataagtggatggttaggacctcttgcttcttcagtatgtctctctgaagagttaaggaaagcagagaaaggtggagataaggttggcagggatgggagagcagtatcccgaggctgagtggagaggcctaggctaagcccctgaaagtatgcttcttgtgatgggtgcagggcctctctaagaatggaaaggatgaatgaagaatagtaggactttagcctgcaggaaggtctataagtggtggacctgaggcatcactttctgcctgtttgctcattacttaaaatggtcaggcctgtcatttgatacagaaacctacactgtctgggcatccttttcccacttgtgtgaacatgggttgatttctgaaagagtgattatataacacaaattatatataactagagttgctttaggtgttagaatgggtgcaaggggaaactcagctactttatttttctcttgctttgctcttctgtaatttcctagcctcttggtccccctttccccccaacccccctcctacccctacacacatacatacctgtacccctcctgccgaaggcttgacagtgttgcttggcaaagagccaacttcagaaattttcatccactggctatctctgtgtagtatcccttgctctacaacataaaaaagaaaatcaactgatttctgaagtgacataaagacgagagaatggagaagattgagctgtatattaaattgctttctggttatcaaataaagactcctttgtcataaaggccaaagataaaaaagaaaatgtgtatgtttaatatatggaacaaaaataagtctatttttgacatagtacttgaggagaagatgggtcaaaaagcccagccacccctgaaatgaattttagactcttattattggtatgatggggcagagagagatatcagtgatggttgcattgctgatagaaatgattttttacagtaggtgctaaattagatgtagaaaggagagttatcaaacctacattgtcatgtctgaccttccaggtcccagtcgaggaatcatcataaaaacgagttgtgggcttatctagagatgcagcaataactggcacagaacaattttcgagcttctcttcaaatggggtgacaccaggggttattcggggtagggagggagatgcattggctttgatcagtttttagaactgtatagcagcttatctgtgggtcagagaaatttcgttttctccattcttttttcatcactttttcccttgggtgcgatgtggattagcgtctggaagctggtatgaggctctgagcattaatagagtttgcgcagatccagactctgttttcgcaatactgggctcaagctcagcctcgctgaatgttagattcagtaaaggcacattaccatctctccataaataaaaggaagagaaatacttaatgacaatgtagaaatacatagaactccaggatactaattagcaaaactcacactgcatttattttatccagttgcacagtgttactctctcatagttatgtctctaacataacttccttttttaactttttgtttaattatattgcctgtctttaagaaaataatttataggtatcaggcattattattaagcaaatggtaaaaaataaataaataaataaaaccacttgctgtcacccttcctaattttaaaaaatttataacatagcagaacttttaaaacaaaaataaaaacagtgtagtacatagacagcagcgagtttgttgccccacactatctgctaggttttgaggatgggacagactttgagagttttagcactgtaactgctaatttttctaaaatagcagtgtgagaatagttatcttgtcatatgttaaaggaacattttaaattttagaaataactgaaacttcttcatgcattggtaatatttatatcaagaatgtatctagaaatactaaaattattggaaagtaaaattcagcaagacttggattaagccctatttgctttgctttatcaaacagtttagattcagggtattcaaaggggcagggaggacattgatggggacacagtatttattcttgtagtctcaggtatttgggtataaaacctagtgtcttcagccaggtgtggtggttcacacctgtagtgctagcactttgggaggctgaggctgttggattacctgaggtcaggagttcaagaccagcctgaccaacagggtgaaaccccgtctctactaaaaatacaaaaataagctgggtgtggtggcaggcacctgtagccccagctactttggaggctgacaggagaattgcttgaacctgggaggcagaggttgcagtgagctgagagtgtgccactgcacttcagcctggtcgacagagcaagactccgtctcaaaaaacaaaaaaaagaaacaaatacaaaaaaaaaaaaacctagtgcctaatatatgtatatatggacagcaaatcagttgtctggctacattctggactgcaattaattgtttatttacttttcttaaggtaagggttaaccgtgctatatagctgttgattttttcctttcctaatatttttctctcaacaaaagatactaaatgctgtcattcccccgttctctatggaacttgtcattggagaaaggagcaatctttatgagagtgcaaacatactaaaaagaaattcatgcctcgaatataaattgactcaaagcaaaatccctgggaaacatgtttcaaattctggaatttttacaatgattgtcttgaagtactatttatagttacaaaagtaataattccatccagcacaaaaatttgcatttgagttagtaatctggtaagcactgttaataccaaatgtcaatattcagaatttttggaattaattcaacaaacatttatgcacttactgtgtgcctggttgcttggttaagtaattatttcttcccactagtttgaaagctctattgagttcagtggcctcatccagctttctttctgtctcactagtatggtgcctgcacaatgggcacacagtaaatgtgtcgaatgaatatgtcattcaattaatcacctaagttttagagctcggcgaatggattttagatataaaggatgagaatggaaacagaaactggttgggaggctctgatgaggaatagaaacagcaattgaatatctacttacagaggaatgaccaagtagtgctgaggtggcctaagtccccaggtgctcagggatcaagtgatttaactatataaggtgagcgtgggagactgtagggggaatgaaggacaaagcaatgtggaagctcaggttactgacaagaaatagattgaagtgttgtgtcatgaatttagagcctggagggaaaaggtgacctgaatggatagtttgaagaactagaagtttcaatgaaggtaaaactgaaatgttatgaggttaaacgggtacacagcttttttttttttttttttttttttggccgtcacccatgtgcaaggcatttgaataaagtgttactgaaggaagggatgctatccagatgaccaagacatggtttctttcttcaaggtggagttgactcaccatgaaagtggtaaagagatctctggaagcacatagttgagtgggttctttctgtttgggaggatcctgcatggaagaggtgatctttgaatagggctctttggaaggaatttaatacatggagatggtggcggaggcattccaggcagagagagtagcattagcaagatgtagagtcagaaaaatgcaggctctctaaggaacaagacactgcctttggtgttagctggaaaagtgggacaagctttaatgcagtacttgaaatttgattccctgagcagtagggagtcctaaatagaagagtgccattagttgaccatgcattatgaagcttactctggcctcagtaaagggggattaagcaaaggttctaaactgtggcttcacattctcatcacctggagaaatttttaaaaccccaactcctgggctgcaccctgtatcaattagaatatctggcactggaacccacacctcagtattatttaaatccccaggtgattccaatttgcagccaggattgcaaaccaacggtttagagcaagggttagtaaactctaaaaaggggccacatagtaaatattttcagctttataggccatacattttctattgcagccattcaactttgccatcatagcagaaaagcaaccgtggacaatgttaataaaggaatgagcacggctgtgttccaataaaactttatatatataaatttgaattttatataatttttacatgccacaaatattcttgtgctttttatttttctttttccagccatttttaaatgtacaaacaaatcacagactacacaaaaggcagccagcagtatttggcccacaggtcatattttgccaaccattgatttcgagggtgaagattggacacaggtagtccaggaaagaaaacaataataatccagataagaggtaaagttaactattgtggtcagttagaagggcagagtgaaggttagtgatattgagttgatatttatagcaactcgtgttcttatgggctacttttgagcacccagaagttgtcatacaaaggacgtttgaatgaaccattgtgcggtatgtggtgtacttagtgccctttgactttgtctttttattttgcagggatttgacctatgtcgtaagactgtttctggcctaactgctagtaaaggctaatcattttggcaacacttattactgcaaattagttaagtctcttgccttccttatgtgctagccttgcctttgttaccaaataatgacctttccttgcaaagaaatgttctctttagaaaataaagtgagcttgataggagaaggtatggcaacctacattttatcacacatcactgaattaacacagaattttctatttgcattttcttcagcatttgttgcctaaagacctgccaggataaatggtgcctgctcctctaccacccccactctctgtcccctgtgaaaatgagaggctgatggttgcaacttccttcctctaaggttattttagaaaccgtaaggctgaaaaaaaaaaagtatttcccactgatatctactgtgatttaaaatcagctgtacatttccacatttgcttggttattttatttgaatatcattacagttgggtgaacaaattcacttacctattttctaacttccactcttagagaagtctgctgttttggtgtcctctaagaaatgcttactctttgcctccagcacttgggtatgtgagaaactgaagaccctgataactttccttgaatctgctgtaaatggatggagagaaagaagttcaagacaacagtcaaaagcatttatggtcatcttagttattttgcagacctaactagagagtagggggtgaaaaaatatatggaatagagccacagccttctttttctttgttttccctgccaccctcacaataatttctcacaaaagaataaggaagtattatatgtgccttatgaaggaaaagcatttgagattttgaagagtttgcctgtttccctgtatattttggggtattttttttatcactaactgtatttcacatcattgatgttataattgatttctaaaacttgaggttcatggtttaaattccagggactttttttcccttcttctcattgatcttaaatgagtattatcatcttagggacactatcaaaatatgtataatataaagtgagattgtgattgagcgctgatattgtcaagtgcttttaattaagcttctgatgctttacacattgataacacagtaaagagtccagtgtattaagttagctttccatttatttttcagaagcacttaccaggtaggggactaaatatacagcagcaggttgtactgcagccacagccttactgtgccccagaggaattcttgcatagagagtccattcttttatggaaaggaagaggtcaagaaataaggcaaagctgcaggcataatacagagattaaaatgactgatagaattgagaacacagaatggcagtagctgaaagacagtagggaaccgatccagaatcatagaggctaacagttggaagagacctttgggatcgtcttgactagtgtttctcatctttggccacacgttggaaatacccgagagcttttaaataatacacttttgtccaggccccagaagaccaattaagtcagagtcactggggattaggattgaagctttggtatattttaaagattcgctaatagttctaacctgcaacaaggattgagaagcagtggccaaatctagcgtcttcattttatataggaggtacaaagcagatacatggcccaagaccaaacagctattgtttgctaggattttaacctcaatcttcttatcttcttgcctccctcactctacattctccctgtgtgatcccatccctgtcctgctttaaattacaccaatatgctcatgagtcccaagtcctttacatgtaacttccttcttaatttctctccaaatgtctcacatcttcctcaaattccctatattcagaactgaattatccttttttcccccagtctccaaaaccagtctcagtctctagactgagtgaagggtacttctgtcagtgaagggtacttctcctgtttggttatctgtgccagcagcctgggagtcctcttcagctcttccctctctgtactcctatctaatcagttaccaagagctgtctatcctacctcccagctgttaatcagatctgtcccaccttctccccttgcccctagcttaatttaaggtgttattttttttctgagtgattttgcaacagcttctcatactgtcttcagcttcttgcctttgtcccacttgagctttatctttaacaccattaggaagctctttctgaagcacaaatttgatcattcgtcactgtattttttccattatgtgttctaatcatttagcctttcttcagcccaactaggactcccttttctctctgtctccatgtacctatattcagtctacttccttatagtctataaaagcataatctatctgtggagtcagttcttttaccgtgcttttatcaaacactgaactctcccatcagaaataacattttccttcttcaaccaaatgctgtcacattgctgactgaatttaatgggcctagcgttgcctacaccctcattttggaacccacccccgcaggaagttcccaaggtaaacatcagacctgccttagcgtcgtccacatccttggtagttaacaccttcacttactcagtgtttactggcttcttcatttcctatccctgacttcagtgtcccttattgcatcttagtaagcccttgttctctgcgtgactctcccagttcctaactagttcttcaccaacgaccccttgactctcagtcatttgttgttttcatcttgcacctcttggctctttcggcccttttgccttaggatgtagttttctaacttctactgagtgtctgtttctgtcgtgtaaaccagtcctggagccctagcgtgtattacctggaattgcactccagtctcttttggaattttttttgggcataactcttggtcgccattagaccaccattgcatttttgcctcaggcactcctgcgtgactctattctgaacctgattgtccagttcgtgagttgccttggctccttatcttttcctcctacctttctgcttcctgccagttgacaggctaactacttaggctctctaccagaaagggagcaggaaaaatgcagcatgctgaaatgcaaacccgctcttttggcttcttaccacgaagtatgatgaaggcttgcagaacatttaaattgtattgtagtataccttaaacatatcaaaccctttgaaaacttgtaggctttatcatttttaagaatccgtatgtagaaatgaagtccatagtcttattatagcttttccttataataacaccattttatttgggaaaactttaatcaacaacttagagaatgggtacagaaaggattgaattggcttggggaaccaaaagaaattaagttcgtggatgctgctaaaatttgattggttgtataacctcacattcagaatacaagctgttattacatgcggggcctctttcagaactgagctctgttgcatatctttgacaaaaattggaatgattacattgtctggaaacctgaactgttaaaaatactctcttggggtctttagttttgtttggttttgtctgaaaaggagtttaaacttgagtataagaaaaaaaaaaaaggtcatcagtgttttctgtccttggagagtggaatataaaagcaatttatgaagtgcctgtaagatgaagattacagaggttcagattctcgggaatctagaagttttaccaaacatgcatactgcctcattttttaaacccacggcagcccgcaaaaaatgcaggacgcagcatgtaattacttttaaatatcctctcatctctgtggcctgtactttgggattaatgatgaaggtaacttgaaggtaccttgtacaatttggggaaaaatatttgccatactcactgtactctggccacccttgttacaagtccatcacacaacttgtttaacatgtttactttttaaatgcttggagagctaacaggtggttgcatgactgagatgtttgttttaacaggctaaaaactgggaggtaatttagacatacactatgatgcaataggaaaatacctaattattccatttttggctcagcttttcgtttcagttaaaactgttgatagcaaggctcgacaggttttgtagagtagttctcttaacattgcctacataggagaaactggctcactagtaataatggccgtgttttagttacttgtataagaaacttacttggctttagtgctagaacttagtaaaggatttcttctcagagcttctgtcatcagcagttacagtgtgaatacagacggctctgaaagccccatatctatttcagcatgctctagaaagccacttggaatattttttgcctgtacatagaagcactgaggaaatatcctgaaaacaagacagctaattgttattatgcttggtacgttcatcccaatgtttcagtatataggttatgattggctcttggaactgtccattgagcaaatagaaggagccaggaattttgcaggatagttagttgttcatgtggtttggagttaagggactactgccggaagtagacatagtcagggatagagtttctagatcggggtggttacctttctctataaagggccagatagtaaatactttaggatttgtggctgtatttcagtaaaactttatttaaaaaaaaaaaacaacaggcagtgggtcagattggctatggggccatagtttgccaacccctgttctggattccagaagatactccactggattgtgtgactgatctcagagggaagaatagcagtggttttcagttaactgggcagatacctataaccttcaatatgccaagacttcacagtatttgtatataataaatttgttgtcagaaaaggcattgtttctttactggttctttggggctaatatgaatagtgttacttagttatactccatttctttcccaaaatcgagataattaggataaaaagcacatataagtgttagctatcaaagtaaaatcaaaacctacattaagtcacacaaaacaacttctgaatattccttttccacctgccaatgcaagctggtcgctcagccatttctgataagcctcagttcttggggcatctcctaagtttaatactgatatgctacctattttattttatctagcataatttcctttctaaaaatattttccccagtgttttatatcaagactcctaacaaaggaagtgttagcatccgtcatttttcttctgattgaagtataagccaagaactgtttcaccgaataagtgggtatatgggaagaaaagaaaaaattataagctaatgaaattttgatgggcaaatgacctgttcaaagcagattccaaggctcacagagctaacatttcattagccacaggaactgtttccaatcatcttactgatacatctttgctctccaggggaagggagtgttaaattactttagaatttgatggtcagaagcactgctcagaggcggagagaggaggcaggaattttggctgatctgtaggagaggacttttcagtgggtgtcagaaggtagcaacaaggccaagtgatttgaaccactgccactggaattgtgacttcaaagacagctctgaaatagggaaactgatctacaaggaaacgatgagtgtgtacaaatgattttatttacaaggtccttattaatatcaggtccaactgcttaactaaggagatgcagaagattatgtagagctaggcgggggtatgcggcattggggaggtatgatagctgtgtccttgaggacactggaggaggtagaagatacttccctagaacacgggataccagtcaaggattcatcacaagtgaagacagaagcagtctcctggcagttggaataacatcagaatagaaacagaagcaagacaggggcagtgttagggacaaacagaccacctgtgtcacagaattttaagatgtggtcgtgggctaacctatgatggacaagaaataaattatattattgccaactgggaaaatgttcaatatctgttctaaaaacattgattacctctgtaaatttagaaacattctaacctttaaatagaagagagaaattcttaagaattaccaacttaagctgagatcccttctctcattcactcttgctgaggggacaaattgatgcaatatttgtgaggaggaggcagtttgactttacctgttaaggtaataaatgtgtgtactgtctgatcctgaaactggacttccataatttattatttttaaatacagtcaggctggcaaagatgtttgtgcaaagaatatgattatattaaaaaattgaaatgaattacagaaaagtttgcatttgtaaagttttcagatgtcaaaaactttgaaaaactccctttagggaattgctgatctgtatgtacaaccaaggaagttttgcgaggacaaactgtgtagtggaaaaagtaaatttccgaacaatatatagtcttccttccataactgcaagttctacatctgcagattcaacaaacagggcatcaaaaatatttagaaaaataaaaaataacagccaggcttggtgtctcacgcctgtaatcccagctaggaggctgaggcaaaaggatcacttgggcccaggagcccaaggctgcagtgagcgatgattgtgccactgtactgcagcctgggccacagggtgagatcctgtccctaagtaataataacaagagtacaatttaaaataatacacataaaaatacagtgtaacaactatttacatagtatttatattgtattagatattctaagcaatctggagatgacttaaagcatacgggaggatgtgtataggttatatgcgaattctgcactatttgacataaggaacttgagcatcagcggattttggtatctacggggagtactaagggacagctgtacatagaatgacctcttttctttgaaagtagtaatcaatgtttgtgtttgtgtgtgtgcgtagaagatttggacccatacacaaattgcttatggtggttatggggcagggatcacagtggatgaggagaaagccactttttttttttttttttttgagatggagtctcgctttttcgcccaggctggagctgcagtgcagtggcactatctcggctcactgcaagctccgcctcccgggttcacgccattctcctgcctcagcctcccaagtagctgggactacaggcacccgccaccgtgcccggctaattttttgtgtttttagtagagacggggttttaccgtgttagccaggatggtctcgatctcctgaccttgtgatccgcccacttcggcctcccagagtgctgggattacaggcgtgagccaccgtgcccggccaaaaaagccacttttatattaactagttggctgtaataagagaacctcatacttcttggttgtcacagatacactaaggagcaggggatggagaggggactcatgtaatgcctgggttcagctcaagaacacgtcattagaaatgaaaagagcgttctctttcttttttctttctttcttttgttttgttttgtttattgaaatggagtctccctctgttgcccaggctggagtgcagtggtacaatcttggctcactgcaacctctgcctcccaggttcaagtaattctcctgcctcagcttcctgagtagctcagattacaggtgtccaccaccacacccagctaatttttttttgtatttttagtagagactgggtttctccattttggccaagctggtctcgaactcctggcctcaagtgatatacctgcctcggcctcccaaaatgctgggattacaagcatgagccaccatgctcggccaaaagagccttctcttcataactaatctatgaggcttatgtgtcatcattacagatattaagagttatatgcctgtataactcatacattcatttattcattaacttagccagtatttattgagtgcctgctgtgtgtaaaacaccatgcagggtacctaggctatatagcagtgacacagtaaaggtatcctcatagctgcaagctccagcagacagacccaagctgtaaccaggaagcctgaaggaggtgtatcgtttaaatgaatgcatgtctgtgcccaattctgagtaacagcagttggtattacaatgaaatcggaagtgccctgtgtattaaattttctttcgttttcagtgttttcttcattttagtctgttatgtattttcaaatacagtttttgatgatgattagtgttttagttatgaaatcttctaggaagaggtcacctggttgctctgtgataatgacccacataaccataaagtgactttggtttttagttgcacccctgtgtcttctcagcctccacaaaggaagaatctcttaaaaaaaaaaaaaaaaaactttatgtatgtagagatatatacacacatgtatattttttatctgctgtcaactcaattgtttgtatgttggttttttgttttttttgttttttttcacagaaaaagcaaaggacaaaagatctttctcgggtgtttcattcttacagtccatatgatcacaaggtaagagaagcatgttaatagcatattaagtattaaagtctttccgaatgtatagtacaattttcaccaacatatggtgattctgaaatacacttaccaattacatttatatttcaatttaaattttttagctctttatcccttttaaagaaaacagaaatgttatatttctgaactataataattatattttattcacattgaaatctagttacatattggcactgaaatctcaaagacagtgaaaagacacattttggggtgtattttggttggttggtttttgttttttctttccaaacactgtactggaggaacttgggttttggattggtaaagataattgaaatgctgactgcaaaacttgattcttcattcctcctgatagaaagttatttttctaaatgaaaatcctaataaaaattagtacatagcatcatgtctgaaatatctactgcctggagctttgctacacagaaaatgaccaaataacgtgacgacccacatgtacccatcccacagcttcatagattcatagtccgtctgtgtcatttataccctaccttctccatccctcatgtttgaaaaattcctagacatcttttcacttgtaagtattttacaatatatttgtaaaagataagcactcttttaaaaagaaaaaatatgtagccatttttaagaaaatgcttaactccacatcttcatggggaaatagattacaaggtttcagagacttgtgcaaaacttctaaaccatgtaggattccagtaaatctgttaattcgaggtgatttcagaagcaaacaaaaaatttgcacagttgaaatgctaatataaacttaaatctttatctatgaatttatagggagacatgtggtagggattttttaactagccaaagtaagtagtgtgaaaactactttcctcagttgaaaatacagagatgtctggattcaggagggaaaaattgtgccagttcatagaagttgaaagaatttgaaacactagcttctagtgtttctatagtgaccaattgacttaagcaccaaaaactcgtaaaagagatgtttatgcttcatgtgaccatggtgatatgtaatactaaaacttatatcattccaagttacatttttcaagctaaatcagtcacattgcagaatgcagcaatttgtttgaaagagattgagagagccaatagggtctgacaatgcagacagaaggagcaggctgataagtaatacaacagcaaaaggaatgagattggccagatttctgaaggtagtgttgcatttttttttagatgaagccacttaatgaacataagtgcagcagtggctaaagttaacatttaacaacaacaacaaaaaaggcgatggcaaatcagaggttttgcctggcttgtctaaatttcgcccacttgtaacatttttaaattcgcagttaagggaaattccattcttcttttattagaactcttaatggaacctagccatttgcagcttctaccggcttcctcctcatatcctttgtggcattgtatcaaagtcacctcagattattttggcttcccttcattcctctacaacttagtcatcaggcagtgaggaattgaatctaaatgcttgatggagttccttttgatctttaagattggtaataaattattgtaaatagctagactgcttgatgagtgccttttgaagctcctaagttttggtctgttgccattctgttttattctggatgtacagtagtgaaggaaaatggaaaagttttattccaggcagctcccggcctccttagtagcctttacctacttttctaagttccatccaggcaaatctatccatgttacttttaatattgtctctcactgattggaatgtccacaaagactagaaccatagggataaagtaacatgcactattttcccaatctgagaatgttgctatttttccccgcatgaattaatagagggttgtgtttaaagttattttgtcatttgaattacccacttatattcaagcaaattggttttctaggcagataggttttagtgtaaagtgttttacaaggtgtggttaaagttggtttagacatctcatgctcagtgagatttctggcgtgatccttatgaaaatatatacatatattgtcagtgaaagcttttatgaaatacaacatcagttgtttggggtttgctttaatgcaggctggtgtattggcttatgccggtaatcccagcactctgggagtctgaagctggaggatcacttgagcgcaggagtttgagaccagcctgagcaacattgtgaaactctgtctctatttaaaaaaaataaaaattaaaaattagccaggcatggtattgcacacctgtagtcctagctaccggggacaggtttaggcaggaggatcacttgagccccggatttcaagttactgtgagctatgactgcaccattttacttcagcctgggcaacagagcaagaccccgtctctaaaagaacatttttttttaaaataatttcaaagagcagagtggatagggtacaataaaataagattgcccatgtgttggtgattatcaaaactaaatgatgtttggggggtgttcattattttattctgcatttttctatatgattgaaatgtttcataatagaaagatacaaaaagtaaaataaactatggtctgctcctgggagtgaatgttgtgacggtttgcctctctagctatattcattttaatgttcattttccccttgacgtaagtttatgccaaaaaaagaatagtcagcattttagtggattcatcatgctgagtaaactcagaaatgcaactcctattctaaacttggcaaaatttccttcgggtttcatcccaaattatagtgggtcacttaaatgacagctttgcctactagaaactgttaaaacagttgtaattacaaagggtagttagtgcaaccattttgttctcagtgagtcagttgtatttgctcttctttccttcccccaaccaagattgctcctgcctgaccccagacacaggaaagtcaccaggttaaacaaacgtgttgtttgagtgagcccaggtgcatttcttaatcataccccaaagccattgtttaggttgtaaatggtcagttggttttctcttaaatgctgttgcaaaaagcaaataaagctaggagcaaaatgtgtacccagaataaggcttagaaaatactttatttcttgcactaagaaatgttgcttgagactagaagaatttcatttttgtttgttgcctctggttgcatgtccatttcttaaattgttttcaggaattcttataataaataaagactcatacaaaagggcttgacaaaagttaactcccatttatctgtccttctaaaagagaacattagtaaaggtaatccaaagtagcagataatctggttatattttatgcattatgttgtttcctttgtcattttaataaacaggtaatgaacataacttgtattatagtttctgaaacaccatactaagtaccaaggagggttacagggccagagagcttccaggtcacaaaaagtccaacctggagttgatttttttttttcttttgataaatcacgggtaagttagagtaggctataattagaacacttttattaaaaccatgcaaattagcatgtgctgtttgtccttggcctgaagaagacatttctctgcacataaaaatgttttcctgtttctttctctgttttttgttagattttatcagaattatgtgtttagggggaaatctaggtttattagccaaacacacatgtttataatctgctattgtgaaaagttattctaaaaaattgaaatgcttggaaggaaaaagttctatttacatctacagtggtttttaacatctgcaaacacagttaatctgcatgaattagtgcacactccaccactaaaagtgagtctttaacaggtagtcactatttttctgtattttgtgaagtgggcttcttgctttcttttagtggcttgttatattagtaatttttctgcatatacatgtcagtggacacacttgagaagaaacattgtcatctagctcctgtgttggtgaactgggcttttctttttcttttgataactatcattatttaattacttttctacatatatatgcatgtatcaactgaactagaagcaaattcatatatgtcattaaacatgtatgtatttatgcacttgataagttagcctatgagtagaaagaaaactaacattagtgctttactcaaccagagcatcttttgtgcagcaatcccacctttttaaaacagctcagaacctctaaaaaagcctatttgggcccagattgttaaaattattgtgtaattctcctcacccacctcattacttcttcggtccctcatccacaaacagttcaatctttttttaaaacaaatcagttcaaactgatgcctggtttcccaaaacacagtcaacactaatagcaggtaaaagagggtagttattgcttcaaaaagtcagagctctagtaagaagtgacagcatcctaaatgaaagcaaggacgggccataaaaactataagtcattaacagaggaactccgaaagtgcagctgcccaagaccacttaatttggacccaaatacccagatatccctatatatttcagtagccttagggtaaaataattgggatcagtttacattcggaaacagatattttgttttaaaatagaatttttagaaactttggtattttagaaataacttttacttaccttgaaaagtctcaggaactgctgcttcttaataaggtagggtaaatgaagtattactacagagagtggttgaataaaagaaataataggctaaacatggtggctcatgcctataatctcagcactttgggaggccgaggcagtaggaccacttgaggccaggagtttgagaccagcctgggcacatagcaagaacccatctctacaaaaaaacggggtttttttgtttttgtttttgtttttgagatggagtttcactcttgtcatccaggctgcagagcagtggcttgatctcagctcaccgcaacctctgccttccgggttcaagcaattctcctgcctcagcctacccggctaactttttgtatttttagtagagatggggtttcaccatgttggccaggccggtctcgaactcctgacctcaggtgatccacccgcctcagcctcccaaagtgctggaattacaggcatgagccaccgtgcctggccaaaaaatgttttaaaaagaaaattagccaggtgtggtgctgtgtgcctgtagtcccaggtacttgagaggctgatgcaggaggatctcttgagcccaggcagtccaggctgcagtgagccataattgcaccactgctctccagcctgggcaacagagcaagagcccatatataaaagaaaaagaaaaaaaaaagctccggccgggcgcagtggctcacgcctgtaatcccagcactttgagaggccgaggcgggcagatcacgaggtccagagagcgagaccatcctggctaacgcagtgaaaccccgtctctactaaaaacagaaaaaattagccgggcgtggtggccggcgcctgtagtccccgctactcgggaggctgaggcaggagaatggcgtgaacctgggaggcggagcttgcagtgagccgagatctcgccactgcactctggcctgggcaacagagcaagactctgtctcaaaaaaaaaaaaaaaaaaaagcagcaaaagagtggttgaataagtgttgatagttgggtaagggaccaaaaaaaatgtgtttgagataaaagatgaggaaagtagaatcattatcaccccaaattatttacttaattagatgctataaaatattagtctttgagatttttattatatttttgtcttaaagaaagactcctctaagctggatgtggtggctcatccctgtaatcccagtaatttgggagactgtggtgggagaatcatttgagcctaggagtttgagaccagcctggacaacgtaaggagactcctgtctctacaaaagatttaaaaattagccaggtgtggtggcatgtgcctgtgtttccagctactcgggaggctgaaacaagaggatcagatggcttaagtccaggagttcgaggctgcagtgagttgtgatcgcaccactgcactctagcctcaatgacagagcaagacattgtctcaaaaaaagaaaaaagaaaagaaaagataaaagacggcactaggcataacttgagtgggataattttaagtagtgtatcaggacaatgaatttttaattgtagtattaaatatacaaaaaatattgatatatatttcaataatcacacttcctatgactaccttaagaactgttgttaattcatatctgctagtgtacagggaattcatatctactagtgtacagtaaaatattatataataaaaatgtaaaatattttctacagctttgggcagaggcatacagcaaaaatctatatcaaaagccttgggttataccaccattccttctttcctcaaagactaggcatctctgtgacatcaagtttcttaaatatggaaaagggacagtttcatttcagatgtcacttactgatttacatttctcttttaatcagatttgtctagtgatttaagattacaaaagtcacttcacccagctctttatgtttgaagaataatggccatttgactcaatcctgagagccacggtattgtcaagccttcattatctcctgtgctttgaataacataatgtagcaacagagtgctttgagttgtttttctagagagagagagatgtgggtttggattcttgcctgctggccctgttgagctttgagctatctgctgtctggaaatagcaaattcagtttttaatggatccggcactctatgatagccaggttttcatggcacatgcagataaagaaacaagttattgatttggcatgtttatgccatgcttaaaacagttctctgcagcagattgtccaaagccatttgtgcacttaactctatttctcatctttggcaaaaataaaaaagtgtttaaaaagtaattttagggatgttgttaaatatcaggaacaattgaataaatgtctagttgatgagattccctattgttttattgatacatgtccttatacgaaaaccatgctcagggtatgcccttgaaacacagggaagtcagtacctcaataagtgttaaatccatttcctcatcctcattctaaagccaaaggaatgacccagccttgaaataaggacatactgaagagctctttcggtgcaaaatctgtgcttttgtttattaaagtatcttccctctcaaagtgaccatagagttgttaccaaagatgcagacatagctgagctgtttcctgcttcagcagagggtaaccctagccattccttgcatcctcatcaatgccaacctaatccaaaggcatttttctcatttttaaccctcgtcagcttgtgatttgagtagcagattatgtttaacaattatacctatacattttggcctaattttgatatcatacctgtatattttttcctttgcctttttaagatggcattattctaaaaattaagcatgattttttacatatcagtttaacttattttcttactgtaactgcagagatgggtagaatcgaggtatttacaaatggcagaaattcggtgcgcttaagatgatatatccagagacccatagatgccagaatttttctcagccagttaccctgaggattgacaaagagattgaaatctgagtagacttttattatgatgattaatattgtaataaagcaaccatttaaagcataccatgtaaccagcactattctcaaagctttacatatgcacataactcatttatctttataccaacattctaaggtgagtatgctagtaaattacagagcagtatacgtggagatgggaaaatggcagcagggcaggagagaagagataggatgccatcctgttcagctgatggcatttgtgactgccttttatggacaggtggggtcacagtgcagagattggaaagtttcctaggtcatcatttaagaataccctacttagcagcatattctcgcccctgcacctccccatccaagaactcccaggaatatcagtaatagggaaaaggcaaagttcatgatgaaatcctttgctaacattcagtataaaagtattaataaattaatcaacaggtctacatagatatggcagttactgtattttcaaattatttaccacgcctaaaagtatctgtgtttcaactgtcattggttatatacttcctctatgaaattcactagtatgaggaagaaactagcaaagggacaaagaggaatgtcactgtgccaagagccagagtacttcccctccatcccggggctggtcacctcctgttctgtcaccagttgccctgggtatgtccctggttatcagtctttgcacccagttaagatgtatccccattctctttctctcttgacgatgtcagagtcttgatacataccctgccccaacagctctgttttttttcctgtatctccccaccagtgtgtgcttaccaacctttcttatccccatccagaggacaaacttggctagcacaccatctacttggtatataagtcctgttacatgccagagttagcaaataaaaataagggacacccccttaaattcaaatttcagataaattgtttttttttttttttagaatgtgccatgcaatatgtgggacatatttatactaaaaatccattcattgcagagcacagttggttctcgcctgtaatcccagcattttgagaggtcagggtgggcggatctgttgaacccaggagtttgagaccaccttgggcaacatggcaaaatcctatctctaccaaaaaaaaactacaaaaatcagctgggtgtggtggtgggcgcctgtagctacttgggagcctaaggtgggaggattgcttaaccccaggagctggtggttgtagtgagctgtgattgcaccactgcactccagcctgggcaacagagagagacccctgtctcaaaaaaatttattcattatttatctgaaatttgtatttagctgtgtgccctgtttttaactggaaaccctagttgcgtgagcattatacattccacttgggcaaattgaggctcgaaagacaaacaacagcacccacaatggaatgaaatacaaaatgattgtaaaacttccccttggtttactacaaaggacctgaggaagcttcttcctattcctaatcctatccttgtatataatgcacctggtctccccatcaaaggctaacacgtgtgtcagctacagtttttcaaacttttattcgttcatttaagaagaaaaagttttaatttgcctttggttctctcaaatatgctgacaaagttttaacctggggaacttgtttggaaaattgttcagcaggcacaaagaaaattaaatttaaaagtgtccatattatattttccaggaagaagaattttccaatctctccctaccccccagaaggttcactttgtttctccgtgatacattttatcataaaatataattaatgacttctttgtagctgaagttgtttatattgagacatactgagaaacattaatgctgctgatgctttaaacaaggaatataggcatccactagagaagtgaggaggccgttactgctttttcctcctttttctgcgctgctcacatttgaagactgtcaagggtcctgtgattggtagtttgggctgatgctgtttgcagactgggctccccaggtctgcctttgtcttcctcagcaatatttttaacagcagctaaaaggccactctcagatgattaccaacctccaacacagattcagggttgcacaaaaccatttccagatttctgtttacaaagaatagtgagatgaaagtatttccatgggccaataatttattttctctggggttttcgtgtaagatttagaagacatgattacagttagcatttattgcacttttaaacgtatacgttaacactcttgaaattgagaaactagagaattttagcatctggaaagaaagtaagtcaaccagcttctcctaatgattgttaatattttccattattcaacactctgcctttgggtacctttgagaattccagaggcattttaaatgcacatgtctcaaataaaaataaaggaattttaaagactcaactttgtttgaatttagctatcgttatgtggtagacacatgggtaagaaaggagactattccacttttaattacgttgaagtataacaataatccagctacaatgcttaaaacagaaatctcgaattcagtttaggctttgcgggtggcagtggagggtgtctttttaaagctgctttttttatctttattatttactttttaattcttatggacactttcatttctaacttaaaagtttcactggatatagctgatgtttttaggatttgcctcactccctctccccttcgtcccgaccatcttcccctcctctgctcctttcctcccctcccttcctctttcttcctgttgagaacttcatttccctggtttactttctgttagaaagtatgaatcaatgaaatttgctaatacttgccttagagggttgtcataaggattcaatggaaagcatctagaatagcatctagcacacagtaagtgctcaataaatgactatgattcttatagtaaaatcatactttctaggatgtcagctctgccactagtactcaccacatggtatatgttcaataaataactggttattttaatgtgaagttacaatttttagaatttaagtagggattttgtctattttgttcaatgtttcctcaacacccaaagcagttcttgacatgtgggaggtgctctgtaaatatctgttgattggagaaattaataggttttcgcttctaaaacctcagcagggtgtgtgtagaaatcttaattcttcctaacagttgcagtggtcatgggttttgttgctttcagtttctccttccatgtttgttgatgatcttcttataccattctttatacttatattttcttagtatcccacctacttttgcatttccccacacaatttcttaggggttcttgctttttttcctctgttgtgagcttgggctcttcaacatggtgcatttgggtacctgtttcccttctattggagacagtaaggtgaaaactcagtactaggttcaatccaaggttcatccattctcccttgtaagagtcttacactatagagctggaaaggcccttagagctcatggagtcccaccgccctcctccatccctcctctgttgttcagggaagagaggcttttttgtcctgttgatttaatactcatccttcaagacccagtttaatttcaccttctttgcctcttttctgatagacacagaggattgctctcacctcttgctaccactctgacttgtatatacctttattatttgacattgtgtgctcatataattcacttccatttaacaaacatttgaggtttttcctaggaggcaggcagaataactagagtaagatgcttacaatccattggggcaggggccccgtctccccgaagaccttgaattatggactagaattgaatgtgttatatatatgaagtgtattttaccattctttgaatctggatactataactgtacaaggcacttacccatcatcccacagcaaattcagggctaaaatccagtcttttaattcccagttttgtgctctgtctttgcaaaaattaatacagttggaatgttccagtagtaataaccacagctgtgggagaatgtcctaagtaagtttatgcttggttttaattataaattaagtaatacatgcacttaataccctattcaaggaaattctccctttgtaaccttatcctagagacccctgttttcttctccagaggcaaccactgttgctggttttgtatatatgcttctggagttattttatgcatacacaaatacataccttcatgtaaatgtcagtatgtgtttttatatagatatgtgctttttaaaaatttaaatattatcatactagaaagtcttctgtttcttttttcactttacagtatatcttggagataatttcaaacagtacctaaagagctgcctcattcttttttaaaaaaatagctgtatatattatataccagttattcaccatatttatttaactagactcttactggtggatctttgagtggcatctgatgtttttggtcttacaaacagtgctgtgcagtgtataatctcacaaacatgtcatcttatcaatgtataactgtcacctgtaggataaattcctagaagtgaatatctagatattagatgtgtacatattaaatcatgatagatattggccgagacccactcagcaagatgttccagtgtacatgcccatcaacaatgtaagacagcgcttgtttccccacacccctgctatacaccatgtcaactaacttttaaaatctttccctattagggaaacaaagataacttcttatagttttaatttatatttctcttatgaatggtgtcactcagttattagaaatagccacaaaaacagagtgatttggtctttgattttaaacttttaaaatccacgttttagaatttctgactcttccacttgcaagctagatgatgtcggcaagatacttaagttttctttgccttggttttctcctctgtaaaatgagaatactgcgttccatagactctaagccattattaagtcttattaattgtaagactcaccattaattcacataacgctaaggaaaaaatgcccattacaatggtgtcttaaattgagaaatgctaaaatataaaataatgtgcatcttagaatcgatgaaatttgctaatacttgccttagaagtttgtcatagggattaaatgggaagcatctagaatagcatctagcacacagtaagtgctcaataaatgactattcttgcagtaaagttatagtttctagaatgtcagctgtaccactagtactcaccacatggtatatgttcaataaatatctggttattttaatgtgaaattgtagttattagaatgtaagtagggattttgtctattttgttcaatgttgtttttttccccaacaccaaagcagttcttgacatgtgggaggtgctctgtaaatatctgttgattgaaggaattaatatgtttcctcttctaaaacttcagcaaagtgtgtatagagatcttaattcttcctaacagctgcagtggtcgtgggttttggggttacgtggtctttacctgtgccgtcctgtcccccatacacacaaaacctctagaccttatcacaaaccacctgatttcattttaaaaataactaagccctatggagctcagtttaaacatttaaaaacctttattaataaaaccaaaaactttgaattgaaagagttcttcagaatattgttgatattttatccaaacaagagtcaaaatgtttttacgtaatctgtacaggatcctaataagaatttggcaagatttatgtaagtcctacattttagaatttgcattttaaaatatattacactgtctgtacaaatcacgtggtcttggactattgttattcagtatgtatttccactacagaaagtataaagaaataaagccttctttttgaagtaccacattttgttttgttttttaatggaacatgagctcataggagttttttcgtttttctcagctataagagtatgggctttaagaaagtctttattacttcacagagtctatatcctttatgcttttctctttgaatttcagacttttctcacattagactacttggctttatagactttgctttggttagtttggttacagatatctgaatatttccatattgcataggcctctctgttttcaacctttgagaatgtaggatgtaatactgatttgttactgtattttatttatttatttatttatttatttatttagagacaagatcgcacactgttgtccaggctagagtacagtgccacaatgatatagctcactgcagcctcgaactcctgggttcaagcaatccccccacatcagccttctgagtagctaggatacaggcacacactaccatccccagttaggtttttttttttttttttttttggtagggggagggtctcactatgttgcccaggctggtctcaaactactggcttttagcgatcctcccaccttggcccttcaaaataaaaaggattacaggcatgagccacctctcccagctggatttaattgctttaaaaagaggagataggaaatacattatgtgtttttatgtacatttgtatgtgtatatatatgtgtatgtatagatgtacatgctgtgtaaaatatgaactctggctgatatcaagactagctgagatgacttaattctccacagatagcccaggttttctggctaatattattttccccaccttataagtgtctttaaaactctgaacagtggctgggcacggcattgggatacctgtaatcccaacactttgagaggctgaggcaggtgggtcacttgaggccaggagttggagacccgcctggccaacatggtgaaaccccatctctacaaaaaatagaaaaattagccaggtgtggtggtgtgtgcctgtagtcccagctactcaggaggctgaggtggaaggatcacttgagcctgggggagcggaggttacagtaagccaagaacgcagcactgcactccagcctgggcaacagagcgaaactccatctcaaaacaaaacaaaacaaaaaaacaggaaaactctgaaggtctttgagtgtactacaaattaagtgtggatattggtgccttaagtttagttgatagggcttgagtcagagtcttgttaaaaactcaacctgtcttttacagtacaacctggtcctgctccggggccctgtgttcaggaactgaagcattcttgttcttgcataagcatctccacatgggtgaagttcactcccacatgttgtaaaagtccacttttatcacagacctatttttgatgtgtttatatgactttacagtcactaacccttcacttacttgaagaagataaggtccaaacctgaaagtttgctctgaaaatttgaggcaaacctattatctccttctgaaatactatcacagtctgcactagggcttagaacaacagatttaaattgctacccagctatcaccaaattagtgccccccaaaggtcagcagctgcaaacacttccgtcttaggaatacctttctaggactgattagtgattcagctttctctttttgtacttgttgctttaaacattcactagttctcacttcagttgtaacatgcacatgttctcattttaaacaaagccaaatggtttttaaatccatggatgaaaaatcattttcaaatcgagtattcatgataaattttgaatatgtaatagatatgtacttaaaacttcactcaaggattgcaaaatacttatctaaacataggtgtttgtgtgtattttgtaattttcaggacatagtttgataatggaatagtgcttgttagcatgtatctctatcagggtttcttctggcttctctggcttcctccttcacatttctcttcatttgtgtctctctgatgttgctgctgcccattcacagtagagtcctgttccttggtaggccatggctgctcagatgcatcccagacatacatgcaacagactcgggggcatttccttttgaatggtaccccagccccactatatccaggactgaattcatcactgtatttattacctcgatgaatattacatctctccagctactgaaccaaaaccagaatgtcatcctagactcctcccactccctttacccactacttttgattgttctcattttcccagatctatacctgtaatttatctgggtttgacctcgttctctttgtggcaatggcaatggccacaaagagaacgaggtcaaatctagataaattataggttcacttggtggcagttttctcctgaatttcctcatctctccccaactgattttcctatttccattctcactggcttctcccaaaacccaatccattctctcactgctttgatggggatacttataaaatgccatccagactgttgatcccctgtgtaaaattcttatgtagccctcagtcacttacaggatacagccccaacatgatccataaggcccttcctggctagtagctccttaccttttacctcatattccatgctttccccagtatgctacactctctgtggtctcagtgtctactcataagttgttttttgtttctagaagccaccgtcacttcattcatctgtttcatctttcccaatatgatattgtttggctgtgtccccatccaaaatctcatcttgaattataatccacataacccccacgtgtcaagggagaagccaggtggaggtgattgaatcatgggggcaatttcccctgtgctattctcatgacagtgagtgagttctcatgagatctgatggttttataagtgtttggtagttcctcctgcattcattctccttcctagcgtcatgtgaagaaggtgccttgcttcccctttgtcttctgccatgatcataagttccctgaggcctccccagccataaggaactgtgagtcaattgaacttctttccttagtcgggcacagtggctcacacctataatcccagcactttgggaggccaaggcgggtggatcacctgaggtcgggagttcgagaccagcctgaccaacatggagaaaccccgtctctactaaaaatacaaaattagccgggcatggtggtgcttgcctgtaatcccagctactcgggaggctgaggcaggagaatcgcttgaacccggcgggggtggggcggaggttgctgtgagccaagattgcgccattgcactccagcctgggcaacaagagtgaaactccatctcaaaaaaacaaacaaacaaacaaaaaacctctttataaattacccagtctcgggcagttctttatagcagtgtgagaacggactaatacaccatcagaaatcagagctgctgcttccttctaggagctctcctgtcttcctctactctcagctcctctggggagttaggtgtccctttcatgcgctcccacaatctctgtgcttccccgacctcattgtgtgtctcccctagataactgaagtttttgagggcagggcttgtgttaactaaagtctatatgcagctctggaggactagtacagtggctgacacataacagatgttcaatcaaagttcatttaaagaaagagggtgatgttttccaaggtcagagtttctcttacacaggtgctctagtatatgtttctttcacacatcttttgtattccatgtacccacaggaaattaaaatcatgtgtggacagcagtgtttccacagtatttccatatttcatatttaaaatcgatctttctattcccaattatgttacatttaagtgaaattaaggggaatgatttaatagcagtctgttctttcctctgtagttatataaagagagtaaagctccttataatggagcgatgccccctccattccagagattctcaaacttgatggcacattagaatcagctggggtgctttaagatatactgtgcttgggtcctacacatatacacaatgtgtgtgttgtgttgcttccaagtgttctagagaataagttatgctcattggctttattatcgttacccattcccatctcagctgagcactcaaccttgatgcttttatgcatctgcagtcagctcattttcccgcttctggctcttctgtaaacttcaccacttgcctgagtcctcttcccttttcctttgcttgtactgcagctcccacccctcatgaatcagtttctatttgtattgctcaaattgcagacgtgagcttgccattttgaatttctagttttacctatgttatgcttaatctgataacctgacatttccctaaggatattaagtagcttattagatattttatttaggactatgttatgaataacccaactcatgctggtttaaacaaagagatcatttatatttataatttattggcttccttaattgaactgtcaaggtagtttttgcattaagcaaagtttgattcaggactcaagtggtatcaccagcagccttttcttggcagtctttgatatattgactattttcaggcttacctccttagaggtagcaaagtggctgccccagctccacaccacactcttcttactttcaaatacgaagaagagagatggcatctgtcctggaatagccaaccaaagtttcatcaaacctggtcgatttgggttatgtacatttctcagaattgggccagggtgttaatgtgttgattgacttaagccaatcaagatttttaccccaggaactgagggtgcaactaacccaagcattgactgggatgtgaaggatgaagcagtggcgaatgcccctaggagagaagaatgaatacaggaagggcaaatagcaaatattcacaataatgcaagttatcatattatctgtcaaaaagtgttccatcaacatttgagtaatatatatttaattcaaaatgtcatacatgtcgatatagaggaattgtttgattgaaccatgttggaccttgttgaatttctagttaagtgaatgccagaaaaaggtgtaatatgttttatttttataaacaatgtaaaaaggccaggcacagtgtctcacacctgtaatcccaatactttgggaggccgaggtcagcagatcatttgaggtcaagagttcaagaccagcctggccaacatgttgaaaccctgtctctactaaaaatacaaaaattagctgggtgtcctggtgggtgcctgtaatcccagctacttgagaggctgagacaggagaatcacttgaacctggaaggcggaggttgcagtgagcctagattgcgccactgtactccagcctgggtgacagagtgagactctatctcaggaataaaaggaagggagggagagagggaggaaagaggaaagaacttgtgtcactgaatttatgagtttaagcttttttgcaaatgttaaaactggctttactaaatattagaatggtacagtagagtctgaagactgacttcaaattattgctttgccatttaactacctggatgaccctgaataagttatttattttctttgatcactggttttgttttctgctagatgcagatgtaagtaatacatctcaaagtttgtgagtatccagtgagataatatgtgttaaagcataaacacacggtccctgacttacaatggtccgacttacaagttttcttttgactttacgattgtgggaaagcaatacatgttcagtggaaactgtacttggagttttaatatgaccatcctgtttttactctcagtacacaattcaataaattacatgagatacttaacactttactatagtataggctttgtgttagatggttttgcccaactgggctaacaaaagtgttctgagcatgtttaaggtaggctaggctaggctacgatgttcagtaggttagttatattaaatgcattttcaacttaaaatattttcaacttatgaatgggtttgtcaggatgtaaccacatcatatgttgagaatcatctgtaatgaaaagtcagagttaattgttacattcaattttactacctcattgggttgactttacctggccaaagaaaatatcatcataattaaaatgtaattctattttgctaacacactgcctttgttacttaaaacctcttttgttttcatgttttattttggctgaagacgcctcagaatggcctatattagaaatatataacaagatattttaggataaaataagaagagatgtgctggtcactcacaaaatctgagtcactgccacaattaagaataaaagcttgggtttctgggaagcaaaggcaaaaagacaaacacagctaaatgcacagctctcattttgtaatagcagaaagtatatcattcaagaggaatgacaaccttgcttagggcaaatctctaaatagaatatattccatcaatctttctgttaaggggtgttgaacagcataatggaccattgtaccataaaacttacaagacccagtaagatttgaaactattttggacagttttcaatggaggtgcagtctgtcctgggtttgaatctgcctttcactcactgtgcaacactggtaatttatttagcttctctgaggctcagcttttttgtctctaaaatgggaataaaaacaatagtacctccccaatggggttattataaggattaaacaagagaatgtatgttgaagagattggcacagtgctctgaatgtagtaagcacttaataaatgttagttgttaaataataattataaattctatccataagtatttattactgtaactagatatctggaaaaaaacatattagcagtgagataattttattgtgattaaagaaagcatgtgattgaatactgaaaaatatgaccagggtccttcaactagataaaaaagaaacctaaccagctggaaatctaaaggagaaaaatgaaaatattgttctggttctctctgagccaattaaaattttctgttgtttttaaaacaagtccattttggactagaactgaaagtctccaacctactgtgagtagaaaaaaagcctatggtaagaaggctcaaaaagctaactgacatatgtgaacccagggtagacctcataatttacaatttcccaacagttcctgcaccttagaattttgcttcgatgtgtgtagactcagcagcatgttgtaggcacgttgatgtgttccagccatccacttatataaacactattgtcttataggagactatacattctgactgcagtttaccaaaaaaaaaaaaaaaaaaaaaaaggaaaaaatggagtaattgtactaactctagatataatacaaaataaaaatacctagagtatttcacacatactaatgcattgatggtagatagctttttaagtttgtcccttaaataatcaaagtaatagaatatttggaattattaaatgttagcactgaaaggagtcaggaatttataaggatcagcttaatacagtcccttttttttctactttttttaaaaatttaggtatggaaacgaaggcccacatgcaattggctagttaataataaaatgaaaccttgaaattatatttgctgactcctagtctgatatgtctttcacctcaccacagggtgtttgttttttgttgttgttggttttggggggttttttgtcattatttatttttgtttctagctattgttgatttttaatgtttgcatttcacagaacaagaacaccctttttttccaagtattctgtgattcaaaactctagtacactctgccttgtagcaaattggacctaacttttttttttttttttttttgagatgtagtttcgctcttgttccccaggctggagtgcaatggtgcgatctcagctcactgcaacctctgcctcctggattcgagcgattatcctgcctcagcctcccgagtagctgggattataggcacccgccaccacgcccagctcatttttgtgtttttagtagaaacggggtttcaccatgttggccaggctggtctcaaactcctgacctcaggtgatccacttgccttggcctcccaaagtgctgggattacaggcatgagccaccaagcctggcctggacctaacatttttataaacccctgatttgctcaattaaatgtgaatttccaggttagttgactttgattggagacccccatacagatggcaggggaagttatagtggtacaatatcacacaactactcacctagagttctgtagacctacttgagtttgtatgaaagacagcttctttggcttgacctttttacttgtctactggtggaaagccacagtagactaggtctcagggaactgccaccaccctggtcccaaggcagacccctccacagccatcgcccaaagagtacagtggctagggttggggcagcaaggtagtgagaagaaggtatggcagaaattgccaatgccaggactaaaaggacctgccagctagtggtggatttggaattcctctttcatcagcaatactgtaagtcctcttatcccccagttttccttctgcaccagctcccaggatgggattaaaaggagagtgttcccaaaagctacttccagggcagggcttatgatataccaaagttcaaaaaacagttacaaaacagtagatccagtgtaaatggcaatattacgtatatgtctgtgcttccaaattgtctaccttttatatagtatgatttgcataataaggcataaaaggagtaagtgctactttttttcaaaaaggctgtgactgggccagagaaaatttggatgactgcattgttcaaaatctggttggctctgatagatttagttgtagatataaatatattttttaatcatgtcttctggtttaaatatagacactgaatttcagaaatcccagtttatgataagtactgcctttcagggtgtttgtctccattacatctagttctaaaaagatatgtagttctgtatcagtttaatttcagttttcttgttaggccattttggcgatcattccccacatattgtgatgacaactacttttatatcatgtggtgtggtcggtattgttatgtatataacagaaaagtcaccatagacaagtcaaaagcaatttgatgcaaactacccattatccaagttttggtagcagtgaaacagacatgtttcatgagagaggattactgagaagacagctgtcatttaacattcctaacactagaaaaaaaccataaagctagatggctactctaaaatgttattgatcagttcagagcattcagttaattatgttaagttttcatcgatttgaagtagtttcaggggagatctctgcattagtgaaatgtttttattttaaaaatatttttttaaaggaatatagtttacttctttcaaataatcccacaaatttagtattccaaagagaccactttgtgattctttaaattaataaataagaaatattttctaaggcatcagtaagactttaaaatgaaaacatcattgtttaaccataggaaaaaaatttaacctatctggtagttaaagcaatacaaatttaaattccaatcaagtgttattttcacctataaaattactaaaaatttttgatttgagaatacagagagttggataagcatataaattttagaaagaggctaatagttcatatcgtttagctcagcaaatcagcttctggaaatctattttgaggaaataatcttagagacagaaagatctctttgcacaaaaatgttcactgcattattatcaataatagaagaaaaagcttgaatatccatcattaaggaaattaattatataagtaaatcatggtgtacacgcgcagtagattaatacccagctgataaatgtgatttacgcagaatttataacagtgtggaaaacactcattattaggaggaaaaaaatagtaacaattttatataagttaggaagtcagccctattttggaactacatattaatgaagatagaaggagatgctgaaattttaaaaatctcttaagctcagccattatacataaggtcttatttatgttaatatgtagtcattccttttttttattattgcttgtacaaaagtaaaagctgttctctttccaaattatctcacatgccaagttatgagggtcataataacatttttatcttaaagcagaaatatctttagataacacatttaagttttccaaataatttcacttcattatcctttttttatttgtgtttttcaatgtattatttatgtatctcatgattttgctgtattactcttctggaagaaattgtatttcctggtaatttctccttgcttgcacatctgtctaccccccaaaactccacacaactagaattctgagacggtatttagtggctgttaggaagtcgaacctatatatttgtttaaattttttttttcagaggttctacagagcatggggattgtttaacattttctaggcacacatgatccagttacaaagacaaagcaccttgtgtttctatagttatttttatgtaaagctattaaaggaacaggaaacatctttcggcagcctttctccctacaactgccccaaaaatagtcattagtattaaacataacagagactaaaattgtttcccatagatccttggagaaaggctgcaaagtaacactaaagcatttggggttatttataataaagcctgtgcaaaagaaacaagatgccaattcacgtgtcaggcagacagtggcagctgctttgttactatgtggcactgtcccatcctaaatcaaatgggaaatgggtactgtttgacagatactgtcatcagtacaaacattattaaaataattaaacagcttcttcttcttttttttaatcttagggacaggctgttggtttgttcgggctttcccagccctggtgctcaggactccatgcatattcctacaccagatttttgatccagccaagcctgagctatgatttttttatcccagtgggacagtgtagctatgttcttggcgttttctgcctattaccagttagggtctgtgaacagaatctccatttgtgagaacctcattgtggatagcacgcagtggtcttttcattttgattgatggttctggttctgcaccatctggcttctgataggctgcattaatcatatcctgaactaagaaagtgtagacatgtctgcttaatatgtacccatacataatgtagcattagttattcattcatcttgcaaaacagtcataatgtatgcaaggtctttatatagtaaaacataaatattaatatgcgacccattaatgctgtttttacttgtactaacctcccactagtacatttgtttatgaagattgaagaattaagagaaagaaggccatgtgcacatttacatgaacacatatagttttgctgatgtctcctataaatttagagtgatgtatgtctgaaatacttatttgctcatatttactttatatatatgtatctttaattgcctcttgaaatacaggttaaatgcaagctgcaatacagattaatttttctcatgtgaactgcttgcatcaaatgtaggtcatccatttgccggggtcgtgggggcgtatgtggccgtgctcttttgtgctgcctctggctgggcccactctgtcccctgctgtgtgataatgtcgagaaaaaaaagaggggccagcagaggccagataggaattcagaagtcaaacaaagtttgctccagatttaggactgtcatacttttcaggagctcaaattcggttttagaaatttgctaggaccttttccatttaagagagatttagtgtgcattaatcataatcctttcagtacctagagaagggaggggaaggggatttaaattctcctgggaagttaccttgtacaaaattgctagagcatatttcttgagatagcaaattaaaaccataacttcataaaacacattttatgttttattaattatgttttgtcataaaagcactgtattctgtgtggttacatcttcttgtatgtgccccaaattcaaagcatgtgttttaatgaattatactattgcagaataagtgaagattaatgcttgcgtgctgcggaatacaaaacataatccacgctgtaacagtaatcagtcatcgaataatgcatgggaaacaaggcaaatgatcatagtttttgttgagaaataagtaaactacagcttctgcttgaaaagtaattgcagtgaggtttaattagtcacataagctctatgagcaataccaacagaaattatataaaatgtaatgcagggattcaaactgacatcttaagagtttcaaatattaagataacaccatgtagaaagctggaaaaaaataatttcagaagtaaaattagtactttaatgtccagctctcccctctcttattttaaaactacttttaactgtttcttccaatagtttagatcccattattgtttaatttcttctattaagtgatttttttaaaatatgcccaccactaagagcactgcattgacaaaccaaactataaagcaggaaatcttacgtaaatagtctatgaccatgaactactgatgtagttctaggaatttgtgaagagtgctaattttgcttggagaaggcagagtttgtgtcttgactttgcctccaaactagctgaatgatcttaaaaacaggttcatactgactggcctatttccagattaaccctcattttaagatgtaatagtctgagtgagatttttgtcttaaaaaaaaagtttaataacctcaagcctggtttcttatcttgaaattgaagatcatccctgcccttagttttagttgtttgtgagggtcacatgagataatgcatgtgtgttataaacttttaagtactacaaaaatatatgtactgtcatttttattgattaaactttcctggatttcatctgctacattcatgagagtatgcaggatgataggttctcctcccatgtcacagtaaattttaagaaccaataaaatgatgaatacatgtgtttcctggtgcctgaatttctcttctgtaagttccctctagagtttacgggagaggttaaaaactacttttccccggtaaaggaccatatgctagttgactacataattacaacataatttaattttcttcttccagcaacatagaaactattggactgtgcttctttaaaattaaggacattcatctggaagctgggacaggactgaaagggaaggtattctaaaccaaaccatttcattcgctcaggaaggcagtgccagaaagacagctttcaagaggccagtgctccgcttctccattggagaacgggtgccatccaggggggaggcatgaacagatggataagttagagaacctgacagctttcctctccctccacgagtcgtcagtagactttgattagaaatgtaataaactcccataatgccaaataaacttccttcaagtatataaataccaaaacacaagtgattttcttatttgtaacattttaatgaatcttaatgtttttgcattatcatgaatatatcagtgtttacattggtcttgcctctttttcatgttaccagcttgtccaaaggacaaccagacatgtgtatggttctccaactcagggaaatcactgtaggccatgttttgtgtttacttagacttcaagtgaagttaggtgtcctctgtatgcttatacctagtgtcatagcacagatttatatgtgtgtaaacaatgtgtttgtaataggactcaatagtctttatatacagttttttaaaactctcattcatttattgtcactgtacgcaagacgttgaaaatacaaacagtaagattctgtgtggtcccatgtcttgacacactctcaggctgttgggaaggatggagatgaacagctaattttaattctgagattcatatgtaatgccattactacccactattagtaattactgtattattggtagtagtgttaatagcaaagcataaatgtgttttaaaggaaccttgttataaaagtttaactgaaggtcatttgaaactttgaaagcacaaagtattcagtgctagcttcatgcctgaaaaaggtctgggggaccatgactcattaattatttcattcaaataaatctattgctctttctcctaagaactaaaaatgtgtactttttttttctaagatggatatttaggggtttctctaaactgttgtggttcttgtgtcaacttcccaagaacacgatggtcccaaggtacctttttgagtttcatatttgccttaaattgtaaccaagaaaaccaagaatacccatccaaataacttgtccagtgctttttccttcatagcactgaactctgatgtgttatttctttggacgccttctcaaattataaaggtaacacggaggaattacttcctagctgtctctcctatactgcaataaattattgtcctctgctcttcccaaaggcctccaaggttattgacagccccgaccagcgtctaccattgccatcccctcgcccccaccccttactaaagtgtcccaccccacacccttgaatacagattagaatcaaagaaggaactattgggaggagaagggggttgggacggtcatgcatgatgcagtttgtcagcattaatgtgaacaaaaggtcaccaagactcatcagattgacaacggagaaagaacatcattctctgcttttagaaattccttattttataatttacctagcatgctgccaattatttaattttgagttaaagatattgttcttggtgaaaaacctatttacttttaatcatagttgattaacctgtatattactagttatgagttatttcacttatttacagtttgtacttgaccgtcaccgccacatgcagatttatcataaaaaggaaggaactattctccttaatttattttgtttttcacagcctgttatggtttttaaaaggagataaggcatgaaaaagccctgaaacaatgggctaaagtcatcctctgaatatgtgagatattttttatcttttcagagaatctttgtaatttagggacattttaagaagtaaaacacgtatagaatgggattttttttctttttttaaaacaatcatttcattaggtttctatattaacgagtctattcacagggcaaaatgacagcatgatagctgtttaagctcattgttttcagatggcagaaacacagagtaacaaaaggaaaagcctccaatatagttaatataaccaaatgttagaggaggtaggaagatgcttgtcagaatcaaataacttataagccatggtgtccatatttttcccaggagtggaaagccttaatatcacagctattcagtttttcattccacaaacatccattgtttataaacatttctagaacaacgctctgtgtagcatacgcatatgccttgtgctcaaagacagtttgcccttgttccttttagtctcctttcagttgtattcttgctgttttattcattttcccccttttccctttcacattaacaaagtaattcactttcatatgtatttctagagttgtatttttgtttcaaatgatgattacatccctcaaccccaaaatgtctgggtaaatagtttatggccatctgtattctgtcatgcaaaagaagatggttcttccaaataaattcaatgactcagccataataacccacatttgtgtgtgtgtatgtgtgtgtctgtgtgtgtgtgtgtgtgtatgctgtatgtgtgtggggggaactatcattttataatttcaaccacagacaaccataacccagagctttttaaatgcccatcctttcacaaacataattttatttctaacatttttgtaatccaaatgtgctaaaacatctaggcagcatgctgtatatcagaaagagtaagtgctttgcagccaagtgaacctggcttggaaaatgctttctctcattgactagctgtgaaactttgggcacgtttcctaatctatctgaccctcacatttgtcatctgtgaaacagggaaaatagtatctattctgtgagaaatacaactctgaaaacaactgattcatagtcagtactcataaaatctcttgcctatttcctttccctttcttctaaataatttcttggataatatgttcagtagtctagacacttggaaatgctgaattattaaatattttcatgtttcatttctcacatctttcaatggcaattgaaaaaaaaatacattaccataagacttaagcacccggacataagcatggatgagctcagtcaggcccatctgtatacatgaggtcaaagtcaggtcccaccccggagaacactgtaaagtccagtttgtctcctccggcagcaagcttctcctttctccttctgtgtgcccttcttgctgcttatggactcggcgacctcgcactgtctccagtcatgcacagtcaagcctgctttcaagagagaatgtgagaggcacgtccattacaagatatacattattgaaaagggtcaataggagagtctccctggctattttcattttagcagaagagttgggatttaagccaaagtattagctactaattgttgattctcatgtgttagtgaacctttctgttttccagcagactttctggaacatgtcaattatgatgtccctgaatattatttttaattggctctttcacctttaagtggctacttttgatgacttctgacccacaaagagatccacaaatcactggaaactgttcccttctggcagaaacccatttcacttgtgaccaagtcatccagtaaaatgcacaatgtcatcaaggaagggaattgggaacagaacagaggatgttacttacagcagaactactagctacagttattcctggtcatcaacatgtcccaggaaagacttaaagagcaagaaaaggtagagaaaaataacttctacctttagtgcaaaatcagttttactgtgcctttcctttcttgcctttttttccccttgaaacagggtctctgtctctcaggctggagtgcagtagtgtgaacgtggctcagtgcagcctcaacctcccagggtcaaatgatcctcccacctcaacctcccgagtagctaggactacaggcacgcaccaccgtgtaactaatttttaattttttgtagagatggggtctcactgtgttgcccaggctggtctcaaactcctggactcaagcagtcctccggcctcagccccgcaaagtgctgggattacaaatgtaagccactgctcccagcctcctgtgcctttctttaaagtctttacttttagaaaatatctgaaagcaaatgaaaatctcattaataatgaagataatgtattacaaacaaaaatacctttttttcccctcaggtaaattacaagggtattttcttcacaatccctaataagggaaagactgcaaaaacgcacagataattgttgataatctcagctttctgctgactttttgcttctttctttgttgtactgttctgatagaggatttgggtagatacagaagatcaaggaggaggaatatagaggaattcacttaattgctaaatgttcccatgaaacatgaatgatacactgtcaaacactggattatatactgccttggtgtgttcacttaattatatcttagcaactagactgtacatttctcaagggtaaggactatgtcttatgtctttgaacacccttaaaggaacctaggctagtagttgacattgaatagtttctaagtaaactcttgccgactggaattgtatttacggcaaagctacttgcaaattacttgcattgagaccaaatgtaaacactagaggagccagacatggttttctttggacacatcttggacgtgcctgatgtcctccccacctgccttgggcatccctttatgataaaactttaattcagtcaaactggtatcactgcatgtttttaagagacttgcccactttctgaccaaattatccatctacccaaggttctcagtcagggtcggtgtcactctatcaaggggctatatggaaatagggagggtttggtcgttgctagtggtgctactggcattacgctcccaggggccggagatgctaaacatgctaaatgttgcacagcacagtctgtcacagcaaagcactgttgtgctcacagtaccgctagcgctcagcattaaaaaacactgggttccttaaaaacttgtcctgcttgctatgtgtattagtccgttttcaggctgctgataaagacatacccgagactgggaagaaaaagaggtttaattggacttacagttccacatggctggggaggcctccgaatcatggcgggaggcaaaaggcacttcttacatggcggcgccaggagaaaatgaggagagaagcaaaagcggaaacccctgataaacccatcagatctcatgagacttattcactatcacgagaatagcacgggaaagaccagcacgggacccatcacctccccctgggtccctcccacaacacatgggaattctgggagttacaattcaagttgagatttgaatggggacacagccaaaccatatcactacacaagccttatatttcaccactccccccttgcacgctatatttaatccttactgagctacttcgttctggatcatgccaagctctgtctacttctacatctttgcagattttatttcttaggctcctgacctactttctcttctagcaaatgttttttaatccttcaggactcactcagcccaggcacctccacgaagcctttgcttcttacaaacccagcctggaatatgtggcatctttacgtgccttcaaagcactctgtgcttccctctgccaggacatttgtcccagtgaattatggttatttactttcatgtcctcccactagactaaaacctacttaagaataaggtgtatgtccccgcgattcactcagtgcctgacacatagtgggtacttaataatttttgaatgaatgactcaatccatgacattgtcaggcaggaattagttcatttggcagatattcactgtgtattcctcataactttatgccaaggaagagtcttggcatgaagcaacactggcattatggatggggaagaaaccttaggagtgaagtaggaagaaggggtagagaaattatccacataaaagggttagctcaggctttattcgctcagtagcccttaagactgtgaatgggatatgtagtaggagggacccagccaacactgttcaaagtttggagcttggacccagccagtccacaaacatattgacccaaaatgaggtaactacagaagttggagtaagcatttaggaatttgacagaataattttgtgtctcttaaatcttatactgaaaacattggtgcttgtctttaatgccattttttctagtcattaatctttatcatatcttataaatcaattggttcctggtggatccaaaatttttttttccaaaaaaaagaaggaaggaaaaacatttaaatagctggtcctcagtagtgtgcaccagactggtctaggtgttcccagcaatgactgtgttttgtaccagattccaagttagatgccaaagaatcagaaatttgctgccagttccttccttccttttctcccctcttggcaagagaatggcttacttgagatagaggcaagcaggtagaacagggtcctctctgagtacctagtgttctaggtaaggcaatagtacttagccagagctgccatatgaaaaaaaaaaaaaaaaatctgctcatctggatcaagccagtctggcaggagactgggacaccatagaatctggggtgcccagtttttacccaaacagtagagtttatggtaacataactaaggctagcacctacctcctggtggactggtggccaccaatgtaccctccattctgatgatgatgagctcaagaactaaatgagactggctggattcataggataaggaccctcattggcagcaactcagcaggttatgggaggcagtggccaacatgcctaggataagaggagcatagtgccaggtattatgaagattcagacatgagcagtgttgttgacaatttgaaccaaaagcatggaccaaagtacgaatagaatgctttaggagaaaaagagaagtacaaaatgtaatactgcagccttaaagagtaaatatgaactagtttgtgtgcaaattcaagcaaggcaacgttacttttacaacattattggaagaagttgaagatggtaatggtagtggtacatttattgactgttaagtaagaagcagtatgaccctcataaagattgtttatgtgtagcagggttgaagtgccatgtgataaaactcataagctttacttacaagagttctaactagtgtagaaaaaaatcctgccagacagcgtgtctgctttgtttggaatagaagcataaatatctaatttgccttgttacagagaaaaatgcatgatctatgcagcatgtagccaaataatcattctatcaggctcaaaatgtagggaacgtagttaatttgcttctttgccctaatccttctctctgaatttgtacttcatttagtcatatttcacctcttagaagctaaaaacacaattttgccagaagatcaaaaataaaagcagcaatagcataagtcagtataccctaaattaggaaagttagaaacacacacagtaacaaatctctcaaagtttgtttttctctcaacgtttctctagtctgtaggttttttttcttttccatgtaagtgttgtgtcatgaaagcaagtgtatctcaggagtgtaaggtaggaccctataaacctttaatattagcatttcatcacaaaagttcctttgttaatttttctgttgaagaaaaatgagggtgactagcagccttagacaaaagcttagtttttgttttcaaacaaaattgacttgatgtggtttgggttagaaattgatattttattttcttaatttgtcaggcttttattttttaggtggtgccttgcctgtgttagatgtttcagtttcctagtgtgtttgtaacacccaaaagcaaatgaatttttatgaaaccataaaaatgatcaactataccctcttatatagcatgttcatgtgcagcataattgtttaatgctgttttctttccacattaagtcaacctgaaagattattgattgtcacaaactctgtttcttcatgccagaattctccagacctgtgtctcaagggaccctagtcgggagggtaattgttgctgctctctgttgaatacccggtgacagcctgtctggatcgactcaggttctggaatggtgcatctcacgatactgagtagcctgccattctgctgtaaagtgggagtagcccctcatttatggctaagggaagagagagttggatggtaaaaaaaaaacagcacaattttagtaggtatgttatattcagaaaagactgagataccattccatgtgaagttttaaattttgccttatttatagatatgtgcccaaatcatcatgttagttactttcatttgtgtagtactttctacaaagtactttacctatgaatcatctcaccacctagccaaataactctcaaacaagttatttgacttctttggtcctcagttttctgatctgtgaaagtggcataaaattacactgcatcctattagccagcctcacagagttgtgaaggtcaaatgcaatagagcttagacatgcaaatgttatattccctgcagcagagtaaagtcacataaatgaacaactgtttttaaagcaactattgaatgctaaatactgtgctgtggtcagcggagtgcagtttcatatactgggaatggattctggcattcctgtgacattttatactgaatcacctgttggtccttaaaaactgaagataggccaggcatggtggcccacgtatgtaatcctagcactttggaggccaaagtgggcagattgcttgagaccaggagttagagatcagcctgggaaacatggtgaaaccccatctctacaaaaaataccaaaaaaaaaaaaaaaagaattagctgggtgtggtggcatgtacctatagtcccagctacctgggaggctcaggtaggaggatcacctgagcccaggaggtggaggctgcagtgagccatgatcattatgcctttgcactccagcctgggtgacacagtgagactgaccttgtctccaaaaagaaaacacaaacaaacaaataaaaaagatgagaacaggtaaattgagtgtggggtgaggagggagataagggatgtgccctagctttacatattttctaagattttctgcttgaagtattcttatttgctttaaatctgagatttacaaaaagtgatttcaacctcatgacgtgtccagaataagttctgctttgctaggcttgagccctaggtggtcatgtccccttaggctgcccagagccttcaggattgtaatgtcttacacatgtttctaggagggctgcagagctgggtggcatggagctcatttgcatgcacttgattcacagcctttatttccaggcagtcacgttttccttctcagaacaatgtcctaactgttgaaagtgtgcagattttcatgtttgttctcaatgatgaagagcagaaagtctataaaaatgttaaattatggtaataaagtaaatgtcttcatttgctgagctgatcttttcacatttagaataaatatctcctttgtagtaactccttagaaaaattccaaaagctttgtaacagtattatgagaaaagatttttttcccctcctcctgtgaaactggttagcaacatcccagaaaactagaattctctagtaacccctaggtcaagtgcccatcttcacacacatctcttttattccacctcacttgtgaaggatcagcttattcctaattcctagctgctttttaggggaccaagttaatgtcaacaaagaatggtaaatcagatttgcaatctgtgatgttagggaatagagtgatatcaagtaattagaaagaatcacacagatcactttaaccacttcacagtccaaagaagcaaagtctctgtctaaaattgcacggctgccaacctggataacgtagcaggatcccatctctacaaaatatcaaaaattcaccgggcctggtggcatacacttgtagtcccagctactcaggaggcagacatggcagtatcacttgaacccaagagttcaaggctgcagcaaactatgatcacgccactgcattcagcctgggctgcagagtgagaccctgcctcaaaaataaaataaaattacatggctggtttatggctgattccatagttcagtactgttgacaataggcaacacaaagagtggtatttcctaaaggttctagtggactagaatgtaacattttttaataaaattaattcatgtgaaaactggcttggagattgtacccttctaaactgctaatatccaatgttacatcctcctcctctccttaatgggtctggactgcatgcactacagttgcccagtaaaataaaacatcgtcaaatactgcattaggtatcagggaccaggcatttgtctgagctccaacacgtgctttctgggtcttggatttttctctgctcttaaattagaatgattaatttaatcattaaattagatggctgacatgaacgactaatgtcttcgtggagtaccattcttcataaaaattgaccaaaaaaaatcacagttcacgtcccagagcccaggaggaaagggtgtttttgatttctgaccctaacctttctaatctatccttcaaattcaggtaggttcggctcagaataaaggtggaaagagccaattggaccttaaggttaaacattggagagaggaggaaaactctttttgacagcctctagtgttatttgtgggatagactggtccctctaagatactcttaaatttggcccggcgtggtggctcacgcctgtaatcccagcactttcggaggccgagacgggcggatcacaaggtcaggagatcgagagcatcctggctaacatggtgaaaccccatctctactaaaaatacaaaaaaatcagctgggcgtggtggtgggcacctgtagtcccagctacttgggaggctgaggcaggagaatggcatgaacccaggaggcagagcttgcagtgagccaagatctcgccactgcactccagcctgggcgacagagcgagactccgtctcaaaaaaaaaaaaaaaaaaaaaagatactcttgagtttacctttctatccaagatttctttggttctataatcaaaataaagcttctgttttcccctatagttttcctgtctgattcagatccaagtctacatttttggaagcctgcacgtgtccatggtccatcagcaataatgtttatggacgccacgaccaaaggcttcttcagcaagcacaggcaggggattgactggtgggggggaagtgaatacctagaacctacggtccaacaggtagtcttttgctgtgcaagcatcaccaagtccaggcaaggaccatttcgagtttttaatacataaggtcatttttttcccccaatgtttctggataaataaaaaagataattttatttagtataaagaatgctcaaccagataaaaacctggaaagcttgagtccacaactttattagtatgttgctttttacttttaaaaatggttttaatatttgatcatccaaaacgtaacacccgagtaactaacttccttatgagattggcaaatagaatatgatgggggtaatggggccattctggactccgtgggagatcagaccatcacacaaaggcttagaggtggaaataataagaataacaaatgctaacttgtagctctgtgtccattgtccactgttaattcacaagagccttgatagtgatcaaagctgagcttcctggttagtgccctgcaaccaagaccaccctctctccttgagtcctgtgggatcctgactttactttgacttgagaagaagctaattatgggttgatttctggaaagaatgattaataatcacttccatttggcaaaataaaatctgtggaggcaacactggtgtttttactaccttatgaagcaacgtgaggaagaaggaaaaaatcatgtataatcttttgcaacaagctataaaatgatttttttttgtctttaattaaacaaaagcatttttattcacagaatgttatgatcatattgctagtacagcttaatgcttactttttaactaattcattttctcatttgtggcagtctagaaaggtttattaaatctaatgactgttttaggattaagtaggcggaaagcatgttctaattacggggatggataaaagcaaactaattaaccaaaaaagtgtatttccttcctcatagatgtctggtcagccatatctgagatgaacttggcttacctagctcctgagttttttaatcatgtttttagattgcattttttacaccatctgtaccattaacatgactgtaatttctgtcacagttggaagcttcagttaataaatgttttgtttcggagcgggatgggaaggcagacaggaaggtgggagtgtttatgaatgaaccaaaagggaagggactgtgatctgaggagccatgaagtgaaaatcctggactgacttagaactgtgaatttggggttgtccttttctgccccaccttataaatactcttaattaatccttctaaaaaaatccaacctagtagaaagtattaatcacctattaatcaccagctagtcaaaaaatctaaataacttaattcatagacaacagagcatatacagaagaatgtgtggttgttttatgaaattcagaaggatttgtttctcagtgttgtgtatatcctgaacaaagcacagaatcacagtgttgtagttgagagttccaaataaataggtattttatcctatttttttaattacagatttttctggatatatttttcttttttttactagtaactactgcttcaggcttttaaaaaacactgattatgttttcaaagttgaagaaaatggtaagttttaaagcatctgtaatttcaaagagtgatagtatattgattaaaaagtttatagaaataaataataaaattttgtttcagggagaggaataggcaagacacaaggcaaactgtagactaattcaccaaaaataagtacacatacttttcaattttaaaagattaccattcatgactaaaaaagaataaactgtatgaagtgaagactgaatttttagttaaaagtcttattatactaggatgaagttttacatcttgtagcataagggacattagctttagtattataaaggagatatcagtatatattgtgtgcctgctgggtgcttagggatacaaaccattaagatagaagcctacctcaagaagcttactgtcagtaaacatttggaggacaaggagttacagtagaacaggaaatgtaatttacttcaaaaaacttttttttttttgagacagtgtctcactctgttgcccaggctggagtgcagtggcacaatctcagctcaccacaacttccacctctcaggttcaagcgtttctcctgcctcagcctcccaagtagctgggattacaggcatgccccacctccaggcctggctaatttttttgtattttttagtagagacagggtttcgccatgttagccaggctggtctcaaactcctgacttcaagtaatttgcccgcctcggcctcccaaagtgctgggattacaggcatgaaccaccacgcctggccccaaaaaacattcttaaatgatgatttatgtaataaaagtacttcagtgatagacaatggaaatagtacttatctggttgcaatgatttgtaggtagtggtcttgcaacatttgctggtgatacatcctaaagcctcacgattcctcacattcccaaaaagccttggaatgtatcactgcatccttaagttatgctaataaaagtaattgaacgtttggagtgatgctggcaggcctttctgaaagtgactgcgttcactgagagacagtaaagaagccacacatagatgcaaacactgggaagttggctaaggtgactcattaagtgagtccatcgtatctatcaatcttgagtaattcgggaattccaaaatgtgcagcagccaaataacaaatgaatgtcccgaacatttatttatttatttattttgagatagagtcttgctctggcacccaggctggagtgcagtggcgctgtctcggctcagtgcaagctccgcctcctgggttcacgccattctcctgcctcagcctcccaagtagctgggactacaggcgcccaccaccacacccggctaattttttgtatttttagtagagatggggtttcaccattgttagccaggttggtctcgatctcctgaccttgtgatccgcccgcctcggcctcccaaagtgctgggattacaggcgggagccaccgcacctggcctgtcctgaacgtttctgttccaactagtgatggtgaggatctaaaaatttcccacataaactgcaggagttaccaaacagcacgcttccgggggcaagaaaagaatggatgttgggtatttatgaatacccagcaaggtattcaggttttcacagaaatacccaggtattacttactggccttgctaaaaatcaaaactcctgatgcctccttagcgattgtacaagcttgcttccatggccatttcctttagtgcagggccgtgttctctaaagggaacagtgtagttatgaagtttgttgtaatgaaattttccctgtgtgaccaaatcttcacccttaaaaccaaacctagttggggcaatgaaggcaaatatagccaaagcctccataaaacttgctttaaacttggcttttagtgtgtgtcagttagccaaacactcttatcaattaaaccagtgaccttgggattgatcagaggaagcagtcaagtccacttgatatttaaaatggcttcatataattcccatgaagtcccatgaaatacaacagcccaagttcaggttttgtcctgtcaacttcgtcctgacaggctttctatattccatcactggctttctaacttactcttccccagactgaaatcagagtaatgaaaacagtcaaactgctcatgaaatgtcacattactatgagagcacacattatttctacagatattttctatcagtcactagatcactactcaaatgacagcagtgcctgcctgaaacatggtttaaaaatgacagccccatactgcaaagactacttcagcagtaaaatttactgatttgtccctctgatcttagcctacaaaagataccaaatgttactcaggaataaataaaacatttctagaaaaggagagaaaaggttatatgcttcattttgcttatcaatgtcatttccaagccaacaattttattaggggtaggagtatggggacatgctatttttagtttgtgggggagaaatgtgacatttagaacaaatgtcatagcatttcttcaataaaaatccatgctgtcagctccctagctctagagaattatagaaaagccgtactgaactaaaggagaggcaacaataacttgatttttagtttaaccctctccgacccagcctcagcgtggctggacagtagtaacagtttttgtgtgttacctagctctgggaagcagtcgtgcattcgcacaaagggtatttgtttaaaagaatctattctgtctacctaagaaatgactctgtgttcagccaaagccctgtgacctgttttgttcattgaaccttgaggagaagcaattttttcacaaacaaaagaactcaaatatctactaaaataacgactccaatatgaaagccagaaaatgacttttattgcctgtaaacaacaaaaacagtagaggacataattattagactttaatagaaaaataaatatgtaataaataaagttctcattatggaacatttgcccttatctcatttcccccttttttggcatatattcacattctatcgtgtagtatctctgggttgttatttaacttttcaggacaagagccatatcttacatttctctaaatcctctgcagtgcctagtacagtttttgataaaagtattgaacaattgaaacattagtttgaaaaatgcagttcgtatctacagttttttttttaactttctagctctccctggcgtgcggcctccacccccaacacacacaatgattattttcagcctttgccattttcaaggctctgattctacttgctccatccttactcctactgagtattaatagtagtctttgctgacagtgacctgtgcactttgaaaatacgtattatcatctccactaagtgcgaagatggagacatctgtggcgtttttgctcttctctcctttgcccttgcaaataattatgtgcttcattcatgatcttttttctgtctttcgtgtctcagaagagggtcctctctttcttcaccaagttctttcttcccctaaactctcaatcagatcccttcagcctgtcctggaatcccaccagttgttccccagtagtctctgtcttcctttttctaactcctccccttcactttcacatgggcatagcagtagtctccaatttaacctgctgtcttctctaattaccattaatttgctaaacatgaattgagcactcaataggtacaggcattcagccaagtaataagggtatactcttgagtaagatgaagttccttctctaaagcagctcacaactgccacaccgattcaaccagcaacttgtcatatgacccccacaaacattcactcagcgaacattcgtccagtcaaattcaggtgacacaatgagtgctaatgacagcccctgctctcaaggagctcgtagtctatgctatttctggagcctatgctagctatacctcttgttttgaacttttacttatttactgcccgtaatgattatttatgttttatatgtaactgtaatatcctcaatgcagcttttcttctattactgtgaggacaaagactggttttcaaaaactgaattactttttgtcttttgtgatctttgtttaacagattacctaaacacagatccctatcattcagccactccagccatgtactacgcagatccaaggaaggagtaccaaacacatctcagtttaggcggccttgcgcatcagtgttcaagaaatatttccattcgactcttagagtaccagcaatttttgaaacactgttccattttctaaatttttttgagtcttttatctctcctattctatttaatcaccctactatataaagccatttgaataattcatgttcactggttcagaagtaggtgatgttttgaaaattcatttttatatgaattagatatatatgatttagtaatttgtatatgtccccaattatattcttaacctgttttttctaatagtgttttgacatgactttttaacacttgtcatctatattgacaacctcattggcagggtagaggtatgtgatttctttttttttttttttttttttttaatcgttaagcgtttaaccatgaactctcaaatacaaagaaaagaattgcctctgtgtggatttatttaagactgtaatgaattaacctaatgccatttgaatttagattgcttctgcctctattctgataagttagcgaacatatgtgacattcattcaattatggcagctgtttaatcatcaatagtaatattttatcttaatcataatgtaggctgtatcacctctagatttgtgtgcccatatgagaagacgggtatcattctcttagctagcaacaggattcctcttaggaaaggagctggctttgcttaggaaactatcttgataaacagttcaatggacaaagttaaaacctgaggacatgagttacaaggaaacaagactaggaaagacagaactaactgctcagcagtagaaaaaaaatagagggatttttttctcttagcataaatgagagaaagggtaataaaagagagggaagaagtggggaataactaatattcagttttaagtggtttgcatttttccctgtgtggacagaactaagccagaaaacaaaaaattgagagctagataagacctggagaatgcaggtcctctggatgtttaaagtcatttgagaaggacactggacttttttcacacagggcaaggatggggaaattagagccaatctaactagatccaaaggggcggggagactccagatgacatctgggtctcatagatattcatgcctgcctttaattcccagccctgccttttactagctgtgtacctttgggaaagatacttaattgccctgtgtctcggtttcctcatccataacatgggaatctcaaaagtgcattttaaacaggttgtcatggtgattaaattaatgcatgtggaagaggttgggaaaatgttttgcgtgtaagtactggttaaatgccacacacatcatccatactcatggaaacacacatatgatagaagatttgggtttgctttttatgtgcatgctttaaacttaactgcaaagaagtaatacatcaaaaacccattctaaggaaacaaagttggcccagtacccctaatttctagcaacttcatctctcccttaaatggaaaatattttataccctaaacaaattaactaatgagtaacttactttctataaaacaatgtttaactccatatgtcatcatgtattttcaaagaccaaaattttatcaatatctggatatattaaccaatccttatacttttgctccttgagaaaaatgtattgcttagtttctgaagcaatggtgtaactaggtcttttgatataatgttaaatgttttaatcatttgactcttgtctacatgaaatggaaatgtaaattgctttctaaaagttgttaagcttcagtggtggctaaatactctacaatgtgtaaaatattaaaataccagagtaggctgggcacagtggctcacacctgtaatcccagcactttgggagtccaaggcaggcagatcacgaagtcaagagatggagaccatcctggccaacatgatgaaaccctgcctctactaaaaataccaaaaaaaaattagctgggtgtggtggcacacacctgtaatgccagctactcaggaggctgaggcaggggaatcacttgaacccaggaggcggaggtttcagtgagccgattgtgccactgcactccagcctggccacagagcgagactccgtcccccaccccccccaaaaaaaaaaaatacaagagtgatgacattaagaatgtaattgctgtctattttgattgcttttatttaaaacgtttactgctgacctattggtagccatttagaatatttaccacatttattacaatatatctagaaactcagttgtaaaaaattttataattcgattcctcaaaatcctttagaaaacatttagatttagattttaaaatgtttagaacatatttttccctaagcaattgttttatctagttttttttccccccgaattatattatgtgtcatcagcgtgtgtgaggatggggaggacagctttaagaagctgctgcatttagtaccaattccttgtacaattgggaggagacttttgaaataaaatattctgtttccccagctcaagctggacatgaaaatcagaaacatggaaggagaaggggcatagccgtgacaggaaggggaaggaatttgatttgaggagcgcctggagaagcctagtctcacccaggacatcacctcccatggtagcacctttgctatcacttagtacattttctgtcttgagacggtgaaagctctttaagagcaggcaccgtgtctccttgctgtatttcagtgcctagcacgtatagaaggttaatgagtatttgttgaatgaattagttgattcacttataagtcactttgcaatttggtgattattcattatgttcaagagacctgtttcccatgcattagtaattagtcctactgggaatgaaatttcataaaatctgtgagaagggcagcctgacagtgtgtgtccaggccttccaaatgtgctccagaatatattataaagggacagggacggatctgagtaaacataaatctgtgaagatgttcattgcagaactgtttatagtaataaaatgtaaagaacaacctaaatatcccatagtgggtgatgagttaaataaatgttgcattcatatggcataatggtagtgactaaaatcatgttataggagaatatttagtgatagggaggggagcgttcactgatatttcaaaaactgaaaatgtattacgagataacatgtatgtgatcctaatttcataaaaattattattacacatttgcttaggaaaaataagactgagcggggcatggtggctcacacctgtaatcctagcactttgggaagctgaggcaggtggatcacttgagctcaggagtttgagaccagcctgggcaacatggtgaaactctgtctctataaaaaatttttaaaaaattagctgggcatggtagcttgtgcctgtagtcccagctactggcagggctgaggtgggaggatagcttgagcccaggaggcagaagttgcagtgagccgagatcgtgccactgtactccagcttgggtgacagagcgagaccctgtctccaaaaaaaaaaaaaaaaaaggaaaaataagactggtaaaatatacactacagtgttaacactagttatctttagcagaatccctttttttcctttttgtgctttttctatatttttgaaaatttctaaaatgaacatttattccttttgtaaagaagggaaagagaaaggaaagttttccagtgccattttgtggagtgatgggacaaatttgtctgaaaggaattgaaacgggaatgggaggtttagaaggaagaacgatggatgtaaggaagatagtgagacatggatcaactctgagctgcagccactggagaatttgtgtggtgggattactagaattcaagcagctggagaggtgcagagagatccctaggagcaagactggtgtgcatgctgctgtggttgctttggcatggaatccttctaagagtatcaaactgtataaagtaggtaggaaacagaaccttgtatgcctggtaaactttgccaaggagaagggtctgctctctgcctaggctggtttttcagcatatgatttaagcatattttcctttgactcttcatatgtgtttattgatttctttttctgcgccatattctttgtttctactgtgatgcttagagagatggtaggtagggtggaaagagatacgctttgaacttggcagaattcagccgacatagatttgatccctgctctatcacttatgagctctatgaccttggaaaaatttgctccagtgctcctagccagcagtgttagaatgatgctgataataatcaccttgcaaggttttaagcaagatacatttatgtaaagtcaccaactcagttcctttcacgataatgggcagccagtaaatgttacttattgttctcaagattgtcttttctcagccagacactgttgtatatatgcctgtaatcccagctactcaggaggttgaagtgggaggatagcctggagtttgagaccagcctgggcaacatagtgagatcctgtctcaaagaaacaaacaaaaaacgaaagattgtcttttctcattgttctttcttgattacacaaacacagtgtgtcttataattacaaagccatatgcttgtgttgatatcttgtttatttgtttttgtagtttttacttaagtaatataaaaaaatagctaagtgaaaatcttcacgaatgaaagcaacctctttgtttgttcctcgtcatcctaaccaaaatcagtagtttgatagtacttctgtttcattatgacatacatctaccagtcacctaacctggccttactgaaacaaaacagtctttgagaaatgtaagcacatcactcagccttgttatggaaaactggcagagcacctgggtgtgcccagagggactgtgatttcacttctcactccataagcaacatccttctgttgtgaattaaatcttcacagtcaaaatctgtgtctgcatgtgcttgtttatttggaaaagaaatgttattcagagaggcattttatttgtaatacttgtggagcaatatgatattaagtgagcttaatattggtagagtgctcttttcattttaaagattcttcacatgcatttgtttttctttctggctttcctctctgttattaggccaacagacaagttatattttatacatatgtgtcagtatgatgctttacatgtgtttataacatatatgaatatggtatatactcttctgtttgtgaattgctgtgcatatctgaggatacgcatgttagtgaactggtttcaatttacacaaggaggtttcttttttctgctttcatccaacctttattgaggacagtaaatactgcctcttatctcccatcccaagctgagttcagcatctggagaagcttaaggtcccaatgcatcaaattatcttgctcaaactgttgtttattacagtcaattttgtcctgtcactccagtggcagaatgtcaaagcttttctttgcattgccttcagcttttagcctctgcagggatctgatatgctgctcctgctttgccagggggtgggttggaggggactcaaagggtcatgatgaagctccaagccagataactacagcactggttaacctccttgctaaagctgggaagggtttatgccccaccatttcactccctggaccacaaacatgcacttcattttatgaatgtctgttaatttcctatgtttccatttcttttcttttgagacctgtgtaaccacaagcaaagcatgtatgatggtattcatagaagaatagacagtgtaagtctagaaacttaatgtgaattttgtcactgacaaatatgtattctgtaatctgaacagtttaatttagataaatagtttatcttttaaaactctgactagaataaacattcacatgaatttcccatttaagtgtttaaaacttcaacttctaacctttttttcagttagaaacatatatgtacctaattatttctttttagttttatataattgtgatcatgtgtataattatacatgatgtagctttctgggatgaagttttgttgtgacaaaaggtgctttccaaatacgtttttgttttgaccattgtcaacatagttaataatctgtagaagtttgcctaatgccttcctctggggcttcttgaccttgttttctgaaacctccttttttttttttttttaatttttttaatgactcctgtaatgtctcatcaaaaaaagcagtttctatagtattcttgaaaaatgagtgtaatagagttggggatgataaatatatttccaggatggaatacaacttattcagataagaaaaaatctggcaataatgaaacatttcacactgattataagctaggaaatattcctgtgtttctacttaaaatcagctttagcccaagcaacctcttcttttgcttggactatggaagttgccttctgactggtccctccatacccattcttgttcctctctcgaatctgttcttccaagggaaactagaatgatcttttatacaagctgtcatagcaacctgtgacactactcttcatatacatcacacttgccattttatatgtgtgtgattatttgatcactgtccatctcccttactagattgtaagttccagaagggcagaggccatgcctggcctatggtagatgctcagtgaagagttatgggacacttaaatgaagacagtcagatctgtactaagttttgtgttgtgaaagtatgtcctcagttgtcctggtttacacggttctcacagataatccactctgaacagcgacacctaattcacttaaccaccacttggttgagatcttacctcctgttctgagtccgcaccataggctagccttttaaaaattaaacccttacttcaggcagagtttgagattcaaaaatttctccatagttccacccaacccagattgggtttgagaatatgcttatgtaacagacaagagtgggagattattgacttcctagctgctcttgaaaaagatctttgcaatgaggcctgattattttcatatcatgtatttccagaacaagcaatgtgcaaaaaccctctgtgacaccaaatgtataggatttgttcttgtgattttgggctactttttgcatgtctcagttttcaacagttctctgaggaagcactttgcttatttggcaaaataagcatattcgtggtccacattgcagacccgctttaagtcacctatctccaggtttgaaagtttccgtggaagaatcaataagtcgcttttggctctaaaatggctcctgagcagtcacctttttgttttcatcccatctgttgttttcgaatgggaaataaagattttcttttttttctttttttcttttttttgagatgaagtctcgctctgtcacccaggctggagtacagtggcgcaatctcggctcactgcaacctctgcctcccgggttcaagtgattcttctgcttcagcctcctgagtagctgggattacaggcgcccaccaccatgcccagctaatttttgcatttttagtagagacggggtttcaccgtgttggtcaggctggtctcgaacttctgacttcgtgatctaccctccttggcctcccaaagtgctgggattacaggcgtgagccaccgcacccagccaagatttttttttttttattcactgtaatttttggacacagacacacacacacacacacacgtgtgtgtgtgtgtgtgtgtgtctgtgtccaaaaatatatatatatgtatatatattttttaactttaatttctggtatacgtgtgcagaacatacaggtttgttacataggtatacatgtgccatggtggtttgctgcacctgtcaacccgtcatctaggtttttagccctgcgtgcaggtatttgtcctaatgctctccctccccttgccccccactctccgatgggctctggtgtgtgatgttcccctccctgtggacacatacatattttcatttaaacagtggctaatccagtcaagagaatagatcctggaagattagaaaatgcaaattaagaaaaaaaatagggatcaatggtaatacaggaagccccttttgttggctgggggggtgcagtgaaggtagtgtcaaggaacagggaagacaaccaccctgttgctggtgacacccagcctgacctttggtgtcagctcatagtaatcactttgctgtcctgagttaaaagctatcatgaaaaccttatgttgaatgggcccatcttccttatgtacttgacaaggctacattttttccctcccctccaacgatatcgtatgagattgacgttatcagaataaaaatactatggattgctgtatttttcaatacagcaccagatcagtaaacaccatcttataagtaacaatgactttctgcttcattaaaaaattatttatgctatagaaaaacaatattgaatggtagttcctttgtagaaactacagctggtgcatgctgtagctctcttttcagtcagtgtaagagataaactgttagcaataatagagagatgcccattgaactgaatatgctctttttaagataaagaactttttggtggtgttaatcacttatttgcctttctagagaatgtatccacttaatatatttataggggtgatctacgtttcagatttataaagtctctgaatatatatttttaactatacacataaaaattaaatttagagaaaagagtctcaaaattcactcttctgtaaagctaacatataaactctgcttctgcatggcttcttttatgggcttggagtaattaagcagacataatataacacataaaggaatttattaggcttttattaaggcttgataatttgagtttcagattttaaatctcaaagggctcataattgttgtcattttctactaaaagctgcatttagaaagaagttaaactgtggtgcaaaggaaaggcacgtttcaatggaaaattcaaaatgcctttttcattaattcagcacttgaatgcaagtgcctattgtgcctagcgggaggcttttaataagtaatacagacgctgcttacatgacttaatttatgccgatattttcttgaaactgtgttagttgcaggaagtagaggtttgaggttgagatatgtcctggtagagagggaagagattatttcaaactccagaaatgtgagtgaattctaatttgccaagccaatttaagtcttagaagtaaggtttttaatttcactattgactcaagaaatcactgggaccattccaggtctctgcaggatgaattttggaatagtttgtaacattgaacagccatcttctgattaaacatcttctctccttgttaactcctaattccccataaaataatctatttggggtcatggaaatgttccccaacaaaagcaatactttaaaatttaagaaacctagaactgaaagctgaacctctgatggaaaacaggtaaatggggcattgaactctgaggcccattccatggttttgcccagaaccagctctggccttgagatttgagttagcagaattccagttaactgaaactttgctctagaattgaaagtaaaaacaaaagccacctgactcaatcagtctcagcatcacatatgtaacttccttgatgcttgttagctttgaaggacctagaaaaagtctggcctgctgggcacagtagctgacgcctgtaatcctagctactcaggaggctgaggtgggagaatcgctggagcccaggggtttgagaccagcctgggcaacatagcaagaccttgtctctaaaaaaaaggttttcttaattagttgggtgtggtggcatgtgtctgtagtcccagctgctcaggaggctgaggtgggaggatcacttgagcccaggagtttgaggctgtagtgtgcaatgatcacacctatgtatagccactgcactccagcctgggcaacacagcaagaactcatcttgatggaagaaagaaaggaaggaaaggacaagagggaaagggggagggaggaagagagagagggcctggcttgaatagcttaactaatgccacagctgaacccttctatggtaatcacagtgaggccaactgggacagaacaatattaggaatcaactccctagcacacaaaatctgcctttaaatttaagcctgatgtataacgctagcaaatgcccgttttgcctcctcctcactgccagcacaaccttgccttgtgcaaaagtcacttctcttgagattactgcagatgtggtggttgttcctgagttctcgttcatgagccaccttcctggggtcggttttataacctcctccacttcattctctcagtgatgcagaggcctcacatacatcattagctgctttagactggatcctgacctcttaatcttcacagtaacccaaaacaaacacccgcttggggccaccggcagaacccaccgtggtttgggaatacagtagcctttagtgtcttgatttcaagtcaccatctttttcactttcctcatctgtttctttttcatcctagtcatgttccctctccctcaaaagttctttaaccaatcatccaaaatccttactgtggaggcctctaaaccacaggcgtttgtcagatgaaaatcagaaaaaggcatgtggtgttgagtcataatcttaaactttgtagtcttgaaataatgctgttatctggccgggcgcggtggctcatgcctgtaatcccagcacttcaggaggccgagagacgggtggatcacctgaggtcaggagtttgagaccagcctggccaacatggcaaaccccatctctactaaaaataccaaaatcagccaggcatggtggtgcatcctgtaatctcagctacttggaaggctgaggcaggagaatcccttgaacctgggagacggaggctgcagtaagccaacatcacaccattacactccagcctgggcaagaggagcgaaactctatctcaaaaacaaaaaaagaaaagaaaaagaaataatgtgtctattttagttattaattaggctccctgtccctagcattgcccctctacctagctccagaatgacctattccactgctcctaattgttggtctactaaatgctggtccaggatgacattttcaccaaactgcagaagagataagaaaaacaaagacagtacaacttacagcttaaattgatgatttaaaagatttaaaatcacttcctattttgaaatgatttattgtgatcatagatttgaaattttaaaaaattatgtacctgcttgtagaatgaaaagtacacaaccttataaacaagctgggttttttaaaaaatttccactcattttactagcatttagaatctcaaaaactgggacctagatttagccagaacccagaaaactgggacctaggatctagccagaacccagatttaacctcactgccatgcctcataccctatagcagccactgtaacctacaaaagcaagtccaggtgcttcaaccataacacacacagaccggggctggccctttaccactatccatcattgtctcccagcattccctgtcctggaactaaattggcttgatgccatttatgcctaatattgctagccaggtaaaatccatccatgatggtcaagtgtaaacttagaagcttatattcataaacacagactcaaaaattctcagcatcaaagatgaggtcagaatgccccctcatcttccctgactactttctgcttgaaacaggcttcccgcctttataaactggattcactgtattcatcatccttgaagcttgacttgaccagctttgtgccagcctttaagccaccactgtagcttgcctcttcatcaacagcatgtatacataatattggaaagaatctttttaaaaaaatgtctttgccatcactaggctgtaaagctccaccagaggaatctaattcatcttcatggcatagcacacactgggaagatttctctttaaactgaaatgaacgaatagacagctaagatgtggttaatcaatgtgaaagcaaaaaccctttctttcctccttccccaggtgtctcttcaaaggaataaacttccttcctggccaaagccttgtggcaaagtaattgaccacagctttgacagcaacaaagatgacctcttcacatccacttccttagccctttccttccactttctgtttcaggagaagaaggaccattttgttgttattaaaatgactatgctgttctaagaatttctgactgattactccactcctgccatcagcttcttctttacggcccaactctcctaaaatatggtgctggatttgttgtgttgtagagtaaaaataatattgttattgtgaattctaaggtcaaaatataaagagtcagaaaaatagctgatagctaatggattctttttatttactccgaacagttctaaaaggatatagcaaatatgttcatagcttctttttacttttgggagtttttacatttgggataattattaaaaatctttataattatccatctccttcattttgctttacagagaaggaaatattgaagttaaatgctctgatttgagagctcgtagaagaaacaacattagtaaattactgtgttgacgtatagttctcattttcatagtattttccatttcattcaaccaaaggcatttctttagcactgaccatgtcatgtggtagctgctgaggacagaggatgagtaggacacttcttactgcctgagtcaaggaggctactaggagagtctgtactctgcgatgacagcacagtgcatggcatcctatgagcgtgctgacttaaaagagagagagctttacgcacctgtgggcaggagtcaactcaggggaagtttcccagaggaagcaacacttgaacttaaagcctagttctgtgattaggaggtgattctggaagtagactgcctggattcacatcctggctcttccactgactacctgtgtgaccttcggaaagtaactaaccattctatgctgtagttcccgaatcatcagatagggaataataatagtgcttacctcatagagttgctgtgagcattacacatgttacatatatgaagtactcagaacagagccagtacagaattagcattcatattgttaggagttgacctgataattaaattgggaagaaaaagggggtagtcgtagggatacagatgtgtgagagagcctgccatgttcagataacttcatgtagtttttcactattaccagaaaatgaggtatgacgtgaaagagtgcagagaggtgggaattgtgaaagcagactttattctgtaggtaatgagggaccgttaaaatgtttcaggtgattagatttggactttgtaaagaaaattcccctaccagttttaaggctggaagagggaaaggtagggtgagtttgaggatagcatgaagtagatcatacataacatgccaggcacgaaatggcatagacctgcaggagtgccagtggaaaagatgctacagcttctcctgcagcagcttcgttaaaggctaattgctttaataacttcttgataggccaggtcctttgacatgctagccatcaaccaatccaatctcctcatctgaaatttcactattaaaaaaacttcagtggacaaaggtttagctttcaatagactaatcaaagagagcatagtagaacattttgattgaaaaggaaaatgttttacctgctaaaaagtatttggatttttaaatttgggatttaaaaaaaagcagagagataatcaagtaactgtgatgcagaagttgctaacctcattgtaccccactctgactgtctgtctcatgtgatgctcctattcatatctacatcagtgccggtctcttaagagggcaggtgtgaaagtgaaaagaaaacaacccttgaagacagaacacccagactgacatctggttccaccatataccagctgggtgaccttgagtatgtcacttaacctctgggagcctcagtttccttatctgtgtcctagagataatgatacttcaaatagttgtcatgaggaacaaatgagataatgtaggtgaaagcaatgtgatatcagaaaagcaaaacaggcactgtggcttgcctgtttgtacatctattatgggctacggttagtttatggcatatcctgtagttctaacaaatgtgcgcttagtttcaatggtgtttttgagcccgtgagaaagagtttgagtagtaatgccattagattttaagtttagagttgcttttctaaaatatttctgccaaaggtactgtcaaagctgacaaccagctgacttaatcatttctaattactgtgccaccaaaagtaaccatgactgattcatatgaactatggcaggactgttttataaatattagaaaacacttaattagcctggaaccaaagatggcaattagtttataatagatatgaaaaccctatccaacaatagccacttaactttaaatcatttagcccatgtcaccagaattattcttttaggacctactgtggtcaagaatacacactctcgttcacatcaaattgatggcaagtccaagattctcagtattctattctttgaccttcctttgacaccttaagaatgcccactctcagatggctactgcaaagcttgtaaactgattaagtgaccaaaatcttaactgtattattaatggatggccatgtgacagtaccttgtctaagacattcttcaccagtgaaataaatcaggagattccattttatttaataaattaaattcatggcttcataagccttactcaaggagacacaaggcactgccagctgatgttataatctatgtcggagcttctaaggccctctgtcatctcattccgcagatgtcttcagaagcccttgaaactattgcaagctgataagtagacgtgcacacccaagaaagtatactaaattataaacagctttgcagaactggcaaagcattatcgtttggcagtaaacctgaggaatggttaagttatgttccaagctgcatttgagatatcctgcatgtagtcaaagactgcagttgaccataggaagcatgctgaccggtggcttgagcataaaagccgaaaatgcagttaagtagatcaagataatcaagttgaagtcaatgtaaatcaagtcaacccttctttctgggggcagttgagaacctcaaacaccgttgtgcccagccttctgctcctcctcctcctgagaaccagatccaaagcagataacatccaggtgctccatctgtttcatcagtgctgctcaggaagggcatttgagattcagtcaagatgggatcattttcaggttcctaacatgtcaagcagcctagaaagacaactcatttgagcagatgctgtacaggtaacatatggaagctacagagagattaatttttattcactagtgggaagaccctttaatacttaactgacatagctacacatgagaaaaatttcttttttatataattgcacatttccttggactcaaagctattgtcttacaaatcagaaagtaatacaccacaattgggaaaagtggaagggtaatttcaaaataaaaagcataccatctgtttctaagggctaaaggaatgttctaaaaatcagtgtagtttcaaagagctataaatacaatttgtaatgtactgtcatacccatacccacataaatagcaggcttttaccagttttcttttaggtaatgtatttagtaaccaacagagccttgatcaacagagctttgatatttttctgtatttttgtcttgcttttaattcgcatctatctctgtttctctctctccctcatatacccttttctcctctcctcttctttataaatatccttcttcgccaaaacataaatatgtaagtgtattgttttctgcccaagacaggagctaatttaaggtagatacacctcctgggctgcaagacaaagttccagattagtcaagacttgtgagaaattcatgtgaggggcaaagaagagattatttatgtggagaaagtgggaacctacataggattatttttatccagatgaaagaaatacgggcagaagcaaactaaaatggtctacaagttgggcattaaaaaaaatacaactggaatattttacaaagtctgccccatggtgataaatacacacgagcagatattacaatgccatgcatctgtgtccccaccaaaaacctgtgtgatttaaaaagtgatgttaatccgactagcataacccttggtgggttcatctgttttctgacaagatgaaaaagtgatagaaaagtcatcagatctctggctgacacagtggcttatgcttataatcccagcactttgggaggctgaggcaggcagatcacttgaagccaggagttcaggaccagcctggccaacatggcgaaaccctgtctctaccaaaacatacaaaaattagccaggcttggtggtgcatacctgtaatcccagctacttgggaggctgaggcaggggaatcacttgaacccgggagggagaggttgcaatgagctgagatcgcaccactacaccccagccttgggtgacagagcgagactctgtctcagaagaaaagtcatcaaatttctgatgaatgtggtatattagtctgttctcatgctgctaataaagacatacccaggaccgggtaatttataaaggaaagaggcttaatcgacttacaattccacatggctggggaggcctcataatcatggtggaaggcaagaaggagcaaagtcacatcttgcatggtagcaggcaagagagggtttgcagaagaactcccttttgtaaagcggtcagatctcatgagacttattctctctcaccagaacagtacgggaaagaccccccccaccccatgattcagttacctcccactgggtccctcccacaacatatgggaattatgggagctacaattcaaaatgagatttggctggggacacagccaaaccgtatcagtagacaaattcatacctatcactgaaagatgcaaagtaatgatgaagacagctaatgttctgtggagcacacaactgaagtttaatgtctgctgtcttcagccttgtctgataaaatgctggaagcatggcacctgagatggtcactgggaccatattttactgtctgcagaagaagcactggtgggatgaatcacctcctgtaatacatgggttaggaagaaaaataacataagtagttttattagttttcttattttaaatacagtgtctacttatgaggttggttggttggttggtttgttggtttgttttgagatggagtctcactctgtcacacaggctggagtgcagtgatcttggctcactgcaacctccagcccctaggttcaagtgattctcctgccttagccgcccgagtagctgggattacaggtgcctgctactgtgcccagctaatctttgtatttttagtagagacagggtttcactatcttggccaggctggtcttgaattcctgacctcatgatcgacccgcctcagcctcccaaagtgctgggattacaggcgtgagccaccacgcccgaccgtacttaccggtttttaaatattttctttcttattaagtttggcattaaaaaaaagtcatgacactatttctaaaatgtttctgatgcaatgaatatgttttactgatattttcatgttgaaggtagggaaagctttgtgtaatttacagaggccgaggaagacagtaagtaccctaacctccccagacagattccactgcttttagttggtactgttaggctatttagaagacttataaatgataatctgtttacagccctgtcattaatcagcagtatttttaaattatcttaatactaaatgaaaagttgaagtaatattgtcaccatcaccacgcagggaacagtagctctgatcacctgattacccacttttattagtaagatatttttaaatggctttgatttgattgtttaaaaaatatatagaaaatctgaaaagtaaagagaagaaacaataaaaaaataattaatcactatggtccagcacacaggtttcaccattatgatcagtttggagtatttgcttcctttagaccttgggtatttattttattttacaatgctatcattatattgcatacaagttacttcttttttttgagacagagtcttgctgtgatgcccaggctgaagtgcagtggtacgatctcagctcactgcaacctctgcctcccaggttcaaaggattctcctgcctcagcctcccgagtagctgggattacaggcgcccaccaccacacctggctaatttttgtatttttttagtagagatggggttcaccatgttagccaggctggtctcgatctcctgacctcgtgatccgcccaccttggcctcccaaagtgctgggattacaggctgagccaccctgcccagccagttacttctaaaaatcatactgtgagcactgttttgtgtcactgaagttctcagaaaccttttctgtaatggctacataatactatgccattgaatggatacatcactttattaactattccactattgttgagcattcaggttgtctccaatattttattagtataaattactccataataaatacctcatactatagatgtattcttagaagcacaattaataggttaaaggatacaggtactattaggttaaaggggttttggtagaaactgccaaattgctttttagaaaagctgtccacactcccaccccagggccttcagttccaatgattaacccttttttgttattggtgaaggatttgtataatgtgcctttgtatttattttgcttatatttcatccagatttttattttgcatcgatgttcagaagtaagattcatgtgtagcaatggatctgaacattttgtggtctgtgactcattcgagaatctcatggaaaccgtgaaccttcctctccaaaaaatgaacatactgatacatatgcagattttcacatattttaagggaacatggacagtcctccccctaaagccagtcaatattttgttgctcacctgatactaagtgctttatatgggggttatttccttgaaccctcacaatcgggggtatcacagaggaaagtcacttggtcaaagtggtatcactatgaaatggtcaagctgggactcactctccagagcctcctgtcttcatgatgttcgtaccccaagggaaaggatcccctgttttattattcctcttccacgccccgtggtcagggttttccagtcatagtcatgctgccttcctaaaatctagtgggatcattttctgtattttttcccatgctctggatctctttctgtagcatggggattgtgtttcttgaaagtttgaaagctttcttggctgggcgaggtggttcacgcctgtaatcccaacactttgggaggcagaggcgggcagatcgctcgagcccaggagttcaagaacagcttgggcaaagcaacatagcgagacttcttctctacaaaaaagattttaaaattagccaggcatggtagcatgcccctatagtcccagctactcagaaggctgaggggggaggatcgcttcagcccaggatttgaggctgcagtgagctaggatcataccactgcaatccagcctggtgacagagcaagaccctgtctctaaaaaaattaaaaataaaaattaaagctttcttctctagagttttttagcaggaaattatttaatgacattttcagttgcttgtgtgtacattggtttcctttgttaaaaatttttgaatcaatttttataattattttctccaatgactacgcatttcattagaatattctttttcatatttattagcatagagttgtatgtaatattctcctggttcttagcacttccttttcattcctcattttgtcttttatcttttttttttttttcttgattggctttgccagtgttttgtctgcttcagtattaattttttgtaaatttcattttgtttttgtgaggtttttcctccttcacctccccacaacacccttctttcctcctgcatcccccccacacacccaaaaatactcttggatgagtaattgtgcctatttttatattttatatttttgtaatattttatattacttcttcatttcttagggtgtggatgttgttggagttgttcctctttttctaaatgctaaagttgaatgtggtgtttgtttgttttttaattcttccatgcgtaatggtctgatcttttctatttttcaatcgacttgtttggactttaattcagtgcttatttaggaaagtgttttaaattttcatatgtgctatttttataagttaatcattaagttttggatagtagaatcctaggttcatttgttcaagaagtttgaccattatagggagaaatgaacatgcattgacactcattgatgagaagagaagcttgagggtccacattttctattttgtttaggtcaaaaactacttactgattacctactgtgctcgaggacctgtgctaggtagtggggctataactgaaagtttcctttctcatggaaattttggtctaccagagaatgcagatgaatacacaagcaattacaggaactgcaggaaaatcaactgaaaaactaataagaccattgagtttgagctaactacaagataccatcaaaaataaaattaaggtcagacgcagtgactcatgcctgtcatcccaacactttgggaggctgaggcaagagtaatccttgaggacaggagttcaagaccagcctgggcaacatagtgagaccccatctctgtgaaaaagatttaaaaattagcaaggtgtggtggcactcaactgtagttccagctacggaaggctgaggcaggagaattgcttcagtgcaggaatttgaggcagcagtgaactgtgatcacacacacctctgcaccccagtgtgagtgacagaaaaaaagagagatcctgtctcaattaaaaaaagaaagaaagaaaaaattaacagaaagggacaaattaaataaacacaatagaaaaagatctcattcgctaaaggaactaagcaaatacacctggaaataaatctaacaaaaaataaatgttgtaagacctttatgatgaaaagggatatttttctgaagactataacagataatgtattcttgtataggacagtgtaacatgatgatgatagtatcaactgtccctatgttattcaatagagtcggtataatcttagtcaaaagttcaacagggtttttgatacattttagtacaaagtagtaaaaaacttacacataatgaatgagggtaaacaaagtttaaatgaggaaaaatagtctcaataattgtaattcagttattataactcaacagaaaaatggacaaagagattcaataaacacatgaaaagaattccctctcaatagcaattaagaaaacaaaaactacaaaaaaatatttgttccccttttatgtcaacaattaaaaaatgttatatacagtattgttgggtgtaggtaagaaaaccctcataaactatgtggagagaggctgtggtcacagtgctaaatgatgccaagaataaaaaaacacattgataaggccattttggagggcaatttaactatatatatatatatatgaaaatcaaaagtataactattcttccttcaacctagtaattccacttctagaaaaatgctcaccccgtatccaaagagatatgcgttattgttggtaatagcttaaaattggaaacaagccaaatgtctattaataggaaagtggttaaataaattatggcatcttcattatatggcctcctgtgcactcatctgaaaaataaagtagggctttatgtggcaacataaggcgctgggctttctcctgagagcaatggggaaccattgtagggttttaagtggaggcacgacatgaccagacttgagtttttaaaatatctctctggatggattatggattatgggaaatggatcagagagacataaaatagagtcaagaatcccattaggaggccatttatccaattgggcattaatggtgactccaagatatggcagagctgaaactgcatttacacagccaaaagatacttaggtatggcaatacattgtggtattttattttgacgttattttgggcagctttggcttacaaatcacttacctagacaaggatgataaaataggttttctgactataaaatctatttactaaattggttagaattacaagtctattcattttgttaaatttgctttccaaataaagctgctcacccctctttgttgaaacaacaaagctcatctaggtgaccatccctctctttttgccttgactctcaggaagctcagagacaaatttagcactcaatgtagtgacctatacttaggtttagattataattagcttctactttttcttccacagatttagccttttatttttattttcaaaggctacatggttatgtgtgtcatttattgtacactgatttctccatttttaaaaaccagacaggtttaaaattactaataaataagtgaatgttaaagttaccatcttagctgcatagtctgtttgatcccttggtgacttgaaaggtgttgtttgacttttatctcctaaagttgtgaatatttcatattgatttagcaaaggtcttctaataaagaagggaccattttaacttcacagcaggcttcatggtagtaatctgctcctcaagattaattaagcatttgtaacattactttataactgtcacttgtctgtaaaattgaagaggtagcatagcatggtagtttagagcttggcctttggagccagactccagggtttgaacatgggctgtgcccgtcacctaccagctgtgggactgtgggcaagagacttaatgcctctgggtctcaggctcctcatgaagagatctctactgcatggggtgttttgagtattgaactggctaatatttgtaaattgcttactatagttatttgttaagtgataaaatggaatggagatttcttttcctgttgtacatccttaggtggaacagatgttaattcatttaagactatgtgataagaggaacattaaaggtttaacccttgattcttatttttgtatgcatgtaagtacagttctaaaagaaaacatttttctatacattaatgaatttaaaatcatagattgtttatgcgtgtttaatgctgattaatttggtgttactgttgcaaggccaaacagtgactcacaaagaagtgaacagactggcatttcaaacaatgcacaggcaagacaagtgagtctgctaaatatgcagctcatctcttcaatggtgaaattttagatctgcttggtttctttggtaaattatagtctaaaggagaccaaaatattgcttggaatttatttgcgtagcaagccgcctgcacatgaaggatagtacacgtgtgctagaatgtgaaatcttataaagcacaaggcagcttaggcaaagggtcttcctgtacccgtagtctgagaatgtcttcatgggctggatgttggtttttttttttttgttttttttttttttttgagacggagtctgactctgtcacccaggctggagtgcagtggcacgatcttggctcagcgcatcctccgccacccggcttcaagtgattctcttgcctcagcctcctgagtagctgggattacaggcgcctgccacagtgcccagctaatttttttttgtagttttagtagagatggggtttcaccatcttggccaggctggtgttgaattcatgacctcatgatccacccgcctcagcctcccaaagtgctgggattacaggcgtgagccactgcgcctggccagatgttggtttttaaaaagcaatcctcacagccccctaactgttagataagaattatgattttaaaaatccacaactctgctattcatttgaattatttacataagcaaggcctctccttctcaaattggaatcatactgcaatatgctttttgaggcttttgggtattctcagttaatttaaatagacttgagtagaatgaaaattgatcaaatattgcattgtttttaaagttaggtctcttgtttttcacttgagagatttttttcctccactttaatacattggctcatttccatttttatatttcttagatatcatgataattattgttttgataaattcctactccccatccgcccttacacatacacacttaattttgttagagaatgtatctgttatcaaatacattaagaactacctctgcattgtaatgattatgaatttttcagagatttgatttaactgcctaattctgtttagaagcctcagtttatgagtttttttcccactgtcctttcattaactactaaaaatgaatacattaagaaagtaggtgttttaaacaaaaccagaacacttgatttataaaacaaaagcttgatttaaagagtatgatatgtcttcaacctggttgggtattatttaaagttttcctctgatcttttttttttttttcagtagcaaagagatatattatctccaaaatggctaatggatctatccaaacattggttttataaggaaattgaagaatcattatttacgaatatatttgacaattttccaaaaagataatgagagcagacacgtggtgtaaatagtatgtttttgataaaaatgttctcttagcctagcaaccaaatcagaatgttgaacaaacaaaatgagaagtaaaatgttaaaatgcattctgtagtattttagttaataattttatatatggttctttaagcttttcccattttataattgtcaaaactaaacagcttgtccaaacaaaagttagaatctcacttgaacccaacctatcacccactgatactttctttagtctatcaactatgtaatgaaatatgtcatgaaatattattattaaaggctaattccagccaatgttgcaagcataaggcacaggagaagatgagagatggagatttaaggggcaatcatatagtatccaaggaaaaagccttatcatggggaaagagtaagatgatagagaaaaggaaatagtcaagaaattaacatttctgatcatcattctaaactatatgatgggggttacatatttaaggatcttttataacataaaattcctgtacaaagccagtacctgtattttctttgtaaatccattaccatttatattgtaattctaatgatattggagaaaatatgaattatgagtgtgctgttaatatgatgtgccctgtgtaattctgaactcaaatagtgaagaggaagccatgtttatttaaaatgtgggagcatcatttttcttaacatttatttttagtgttaattttatcttgcatataagaccttacttggaaaaaagagaggatcacatggtgaaaggtgatcttgttaaaagtcattgcagaacaggttaatttgattgaaaatgatccccccacaaaagtttccaaattataacttagtctcttgtaccacatggacctttctagttataatggtgatatcaacatcccagcaacctacattcgtatagcaattttcagtttcctaagggatagcacctgctctcatttgttaaatgaactggttatacttggttctaagtgaggatccaagaggacttacctaagcacaggagggcttgaagccgaactccaacctctgcaggtttcatggtctttctacagcactctgatagctcacagcagactacacagcttaggaaataattacagcctgccacaatttttcttaatttttaactgaaaaacaaaatctcaactctaaaatttgatggacagtgaggttagtttgagaagttgagaaactcttattttccattatccctgttatcttttcacctaggacacagcaagtgacgtgctcattgcatgggcagagattttcccactcctggcactgcttttatgctgtcacctcttttcagggtgagggagggccacaataactttgcaaagaaagtcccaggttttcaaagagagcagagagtgtggggtggaggtgggagagaatgagaccttagtagaaacactacctgaaataggcatataaaacaaattaccccaaatcaacaactcattatcattacagggtttacttgttcgcagatgtttccttcatttatcagtctagggccttatttaacctcaagactaatactcaacaaagccacatgctaatcatgaggacacctatacaggggcaagtagttcctcaaggggcatttatttccctgtattttctaggaaatgctattgggagggtgtattttaataattagcattaaatttgtttcatatttttgcctagtagctttctctcaagctaaagaatttggaaagacttgtttattcattatatatttgtacaaaaatcagaaataaagttttgaggattgaatattttaagctgttattaccttcctaaaacagcatttttgtttgctgcagtagtctttttccacatatacttcaagtaatggaatactatcactttgaattttaaaatgttaagcaaaacaaaaaaagaggctggtcctggtggctcacacttgtgatctcagcactttggtaggctgcctgagtccaggagttcaggaccagcctgggccatatggcaaaatactgtctctacaaaacaatacaaaaattagctgggcgtggtagcatgtgcctgtagtcccaggtacttgtgaggctgaggtgagaggattgctcaagcccgggaagtcgaggctgcagtatgctgaaatcatgccactgcactccagcctgggttacaaagcgagaccctgtctcaaaaaaaaagaaaaatcaccagcttcaccattataaactatgtgattctgggtaagaccacctcaacccaaagggcattggtttcctgatctgttgaatgagaataatgtctactcaccctgtagggtgtttggtgacaaaataaggtaaaccatttcatcaccagaacaaaagtagtggtatggtaatgcttgtgttcatagtcatcatggtggttagttgaagaatcaaattttctccatctgatgcttgaactttcttatgaatccttcctacccactaccaccttcatttaaaacagtgactctgagacctttaagtttctttttttttttttttgacctttaagtttcataccacacttgccagtccttgtgataccaaataatacgtcaactggaatacaccagcaggcttgttttaagtcagctatttacagctgctagtgtttttagaagcaagcagaagttagctgtctggtcccaatggtaattatctgatcttacactgatttctagaaagcctcagagggacaccacctgaatcaatcagaaatagctagtaaggaaattgaattaacattttgaatttaaaaacttttttccagatacattttttttttactatgtatgagtcacccttaaggctactaattttgctccattaatttttattcatcttgtatgtctgctaaaaaagaaacagcaattacatcttttcaaagaccttttgtagtttttatcttctgtttgtgatctggtaagaaaagaactgtttatatctgagtttcattttccccaaatctctgcattagtttgaatgtatctctaaagcttatgtgttagaaacttgtcttagtcttttttttctgctgctataacagaataccacagactgggtaatttataaagaaaataaatttatttctcacagttctagaggccgtgaagtccaagagcctggcagcagcatctgaccaggcccttactgctggcagagagatcatgtggtgaagagcacaggagacagagacagacacagacagaaagaatgcatgcatgtgcaagagggtaggagtaagagagagctgagaaagccacactcacctttataaaaacccactgtcgagatagctaaccaactccggagatagcaactttaatccttcacagggtggagcctaagcttatgaccgaatcaccacttaaagattctacatctcaacactcttacaatggcacttaaatttcagcatgagttttggaggagacatttagaccataccaaaatttgattcccaatgtggttatattgggtgttgggaccttcaagaggttattaggccatgagggcccccatgagtgaattaatgttgttatcatgggagtggtttcttataaaaagacaagttcaacccactcttgctgtcctccctctattgccttctctttgcccttctaccttctgccattggatgatgcagcaagaaggccctcacgaggcactggcaccttgatctttgacttcctggcctttagaaccatgagaaaataaatacattttctttataaattatccagtctcaggtattctgttatagcagcacaaaacagactaaggcagagatctaatcacaaattttacatgttgatgttaaagatagttttcttagtcagtattttgatattaacaggtctgtattttatatgttgtaacctactacaaagcagagaacttttatatggccattttgagaaaatattttaattatttctcttccttctctactggtaagtgaatggtaataatgaaaatttctctttcatttgccatttctttctgctttactgtactgatagactacctgttattaatggtcattacagtacctcttattttctcttaaagaacttgttttatgttttcttcaagacacgtaataagtagcaaagagatggtccagcattgtttactgcagaaaacagtgcactaggaagtttggcacctaagacctatatctaacttacacagtatcctgaaccaaggtacttaaattctctgtgcttctgtaagttggcaaccacaaaagtctatgtgaaagtgaaaaataagaaactagatgaaataagattattatagctgctctttgttatgaagatgataacaaaaaatacagctattctaaggccttcagaataaattatagaattaaatttttgagaaaaatgccattgatttatttcagtttagcaatttttcaaaaggtttcagtgcttgacagtataactgtaagaatatcactatttattaaaagagctgcttcattcatttacatttattgagaacctattgtgagtcaggcatttaggtgctagggataaagttacaaatgaacaaaatctctactcgtggaatttagaatcttgtgagcattcttctaggttatttcccttaaaatttaaggtaactagtttgctgaaattaaaaggagtattttaccctgctgtagtgctatatgtgtgtatggttcttaaacttcacgctgtcctgtgtactgtttagtaacagaattgtttattattatgattctggtatgttaatgaaggggtactcatttgcaaataactgtttaatctgtgattaaaatctggcagctctcttaaaaataaagaacagttaaaatgcatagtcactgtcctgctgtattgaatatgcaattgaaaaacattaagaaaggcatatcctatttatcacttttaatgaatctttcaccctggtcccactgtaagcccttgatggtattcctgtcatcccatccatatgctcctaaaagcattaactattcttggctctgtgcatgccttagtataaaatcaaaatctctaggttttgatcacatataagcaagcttaaaaaaatcattatcattaccatatcctcattaagatgatgggcccctgaccatctcttcatgtttgccttgcaatctaaaattcatgtatgcaaagggaatttttcttatccttttgaaagaagaatgataaatatttatacagccttaactctttcaagcaggcataggatcatgttttagaaatgacagtaagctgctctaggttttttttttttttccagcataattcgtctttccaatagctactgaaaaaaatgaattgcagatttatcaatattggagaattttcctgctctcttcccattaaatatgtttagtcttacatttctgcaacccttttgagccatggcttcgaaaagggagcaaagaggtccctctgcttttcagacagggttcctccagagggctggcagtacgcccaccaggagtgctgacctgtgctcaagcccaggatcctaattcctccggcacctttttgcttttttagcatatttaacaataatctagactctaagtaactagtcacatatccgtacagtgttgctttctaaaagttactcctctctgaagcagcaattagagctccaagacagttttctacttgaaattaaaattccctcatgactacttgaataaagacgtccagtagtaatgttgaagttatgaatgtgtttcagctcacagagctgtcttcttataataaatggaagatatgtgtgaagttggaatttagttaaatatagaccatcctggagatagtagaagtgctgcgggttatgttaccaacaataatctaacttgtcctgcacctgctgttggacctcctccatattattacttctgccactgactcccaaaagccaggttattaatctgaagacaactcaagacccaagccacatcattactgttgtaaaccagaaataaaattctaagccccccaaccaactgaatgcacccctcctcttggccgggggcattcaaagttaacctgaaaaactgatactttaggccatgagaggaagcagggactgggggttggaggggtaggttggacatgcctcattatgctctcctctgtttggaattcaggtacaactgaccagcagtaacattaaaacagagaacttaagactgacaaaacagactttttgtaacaataagataccagattccaacctgattctggtatagcatcacatgacagataacaggccctaaaaaaatgaaaatattttaccccgaaatacatttctttgaccttttttttttttttttgaggtggagtctcgctctgtgtcccaggctggagtgcaatggcacgacctcggcttactgcaatctctacctcccaggttcaagcgattctcctgcctcagcctcctgagtagctgggattgtagacacccaccaccatgcccggctaatttttgtatttttagtagacatggggtttcaccatgttggccaggctggtctctaactcctggcctcaagtgatcaacccacctcggcctgcccaaagtgctgggattacaggcgtgagccaccacgcagaaaccagctcttacatgctgagtagttcaccacacagagaaaggccttttagaattcaagtgatcttctaaggtttattttaactgtatactatcatgtgcaaagtatcatagcattaaaatatctcaccttaggcctccagccaatgcttttatttaattaattaatttatttatttgagacagggtctcactctgttcccaggctggagtacagtggcacattcatagctcactggtgccttgacctcctgggcacaagcaatcctcccacctcagcctctggagtagctatagctaggactacaggtgtgcactaccacgtgcagctaattttttttttttttttttttttctgtagagatggggtttcaccatgttgcccaggctggtctcaaactcctgggctcaagtgatctacccacctcaacctcccaaagtgctaggattacagggtgagccacagtacccagcctaagatttgaatattctcaaggtctcttagttcctacaatgcagtaattttgtagcagtttgaaaatccagacatactatataggttttcccagctactccttgagttggctttgtttctgctatttagtctcaggaactgttgcagtggttcctatctacatctgtgataaacagcttttcctagaacaacttgcagacatggcaatgttcaggtttaagtagacgatgtactattgtgtttggcaggagaggccattaaaaaaaaaaaaagcagccctcatactaaatttcttttgaaaggtgttactgatcaaaaaatatagctcagaattgaaaattgtttggactaaataactgtgtcctttctctcaccttcccattcaatccttccacctaagtagattgatatgaaaaagtacataggattgcttaaagcttttatctttgttagtaatcaccctggaagaatttttaaattattgatttaagtagaatcttttattcttggtttaaatgtatacaaaaactacctacatgctcacctacaatctcgattttctttgaaattcatctattttctcacttgtctacatcaaggggaaatagggagcgaggataggtctgaaccaaagtactcccacttaaatggcatgatgtgtctacgtatctatgtgtgtgtgcgtgcctgtgtgtgcacatagcaaattactggttgcaataaaatttgttagaatttcaatttggcttcattaagtctgagacagtgaagtaatactaagggagaaatagaataggtgaagagaaataaatactagatcaattttctttcaagaaagacgttttagaagaagtagtattcattttttaggtcatcattgacatttctcaatattatattcctataaactgcatatcaggacttgtatgtgcttgaggaagctacattttcacagcaggagaggaaatcagaataaagcattgagatgcaggtgcacagtaatacaagtgggctctttcccctgcagcctgaatgcctggccaataatgcagaagctcttggagccgggctctcagggtctcccggagctaagccaagaagtatgggggtggggcagggggggtcaggagagaataattgttattcagtcttctttaatgagatgtattgcccactgctgaaagattgtggcagtgccttttgttatgctaattagacaccattagagcttggctctctttgatttctgcttaatcttttctgcttcctcagcctcaatcctgactggcaaatggttgaaagatggtggggtgtactgcacgtgttatttattgctcacatctatgctgagttctttggggaatgggggggaatgtaagatttatcttaccaaaggcagttcctattttggacgttcatttttggcttatttttaaaaaatgaattttttgataatgattactttctgccttttaagtccaaatgccactgttttttatatggttgcttttgcagccacactgaatggaaaatgacagattggaaaatgtagatggcctctccttggttgcctgattttccctaaaaacagtgagcaagctgatcatgccataaggttttagagatgctgtggtcaaccagaaaaatggaagcaagaataatttaatggtcaaaaagagcaattttgctattcaaaattcctgcctttacagtttatagacatgtgtatacattccttcctaaaactaaaacattacatttacatgattaccacagttaagagtgtggtgaggttttttttttaatttttttgaaaaatgactaatatcctttctaaaacagtgaaatggtagatttccgttaaatttttaaaaacaacatcataatgttttagagcagccctctccaataaaaatatggtatcaaccacagatgttacttcacattttttgatagccgcattaacagagtaaaaagaaacaggtgaaatttgtttgaataatatattttatttactccagtatatcaaaactattatcatttcagcctgtattcagtatagaaattaatgagatgtcttacattcttttattcatgtgaaatttttgaaatccggtgtgtactttgcactggtgtatgtttgataacacatctcaattgagattcgccacattttaagtgcccagtggccacatatggctaggactactgtatacatggtgcagttttaaagtaattgggtaattcaccacttgcctaaaacaactggcaggatagaatccatttttaacattatagattaaatattatgaggtatgtgaccttgaccaagtcacttaatctctaagggacctgtattctcatctgtaatatgaagagtttgtcctaaatgatctctgaagtcctctcttctatccaatccagctctgaattcatgattttaaaaattctcatttagaagttgggtaggctggagcttatccatcctttctcataatttagtatttgaaaagaagctttcttatgccataaagataattagaaagcgtcctgcataccacacccacacctttttttcttccaaatgtctgaatctttcttggaattattctgagttttataccattggtaatgcctggtggtgtagctcactgagttgcctgactccccatgcttttggaatgaggacttggagcaatgaaggtgtgagggaagttggcaagtagttactgcagattactagattacataaacaatctctctctccaatgcttttgcttttgcttttctctttttttaaatttggcttactttttgtgtcgtcagtgaaacaaaacttctacaagcaccttccaagaaagtgacctattaaatgttatcactggtcacttatgtaccttttggggatggggaatgtatgaaaaaaattttttcccagaagcacagcccagtttcatacatatttttgcccatttgtgaaaaaaaaggacatttccttattttagtgtttattcgttgaaaattaagtgaaacttttttcacatatgtgctgtatgtagataatttagatttttggttttgaattgcttttttagcagtttgtttttctgttgggaacatttattgttttcttactgttttgtaaaggctcttcatattatataacctataacatgtcattagtatatatgtcatacttgcaatttttttctatttgctttttgactttgtttatgacaatcttaatatactttttttaatcagtagttaaaaacttctcatttatggcaacatagcattatgttaaaaatgtttcatcaacacgttacatgtctaataatttatatttcctccaagtattttgtggcttcttctttttcatcttttcaactgacaaataaaattgtatctatttaagatgcacaacctacttttatgagtaggtccctttctgagaatctgctctcaaagaagactggcctagacttgccaagtaatggctgagagagaccagtgggaatagatcaagagggtggaagtgaacggaaattctgttcaatttttaggtttgcgcttttcataaaaaagttctacacttatatccagtgttggctccatgggccctttccatgaatcagatctcatggatagatcttactggcagtatctggccatagaacttcagttttcaatattgagcactttcccaggctgcctgggcatgacagagcttgcccagtgtggggaaaaacagacctgatgtactttgtgccggctctgtgataggagggtcaacttgtttgggtttgttgagagggtagatttcatgttatatgttcttaccacaatttttttttttaattccacaaaaagctttataggcaatacctttgaatgctctagaatactcagaatgtacaggcaggtggttaaaatgcagctgctttttgaactggcagtttaggtagcactagatttggatccctgacgccaggcaggaaggcatcagtgtggcatttcctgtgtaactatttgctcttactattggctctcgatcagcagatgaaaatagctttgttactaagaatgggattttgcccccagctgggaagagactacctcggattgtcttcctcttactggggtagacacggctagaagaaaaccaaccagcgtgaagaaaagcacaaggagattcttgttagaagaaacttcatggtctgattcagtagaactgcctcgggcctggtctttgtatcttgtatcactgcacaaagaagggaagaataacttttgaaaagccaaattgttttacaatttttctttctacttaggttatttctgaaatgcaaagaaagaagaaataaagctactaagatactcatggcaattaatagataagcatatatacttaaaaatatggctactccacttcaaaggaacattcttccccttttgagtacatttatatctattaataagtgtatctaaagaattttttttccacagaggacaatgttttcaaataatctaatgaatgcctttttttgtcattgtttaagaatcagttaaccagtctagcgctttgagaataaactgtccaacatcttctcttaagaacccttaagtagaccaacaaattgatggctagcattttgaatacgatggacttaaaggctcattacttgttttctatgctatcatcatttttgacacacattcttgtgtcatggccctatttcattatagaatggcattgtggagtaaggatgatattaaattttaatgttattgctattattactgttgaccgtttttagcataagtatgcctggttctttaattccagcttctgcagggccagaaaatagaagtgagcataaacagtcaggaaaattactgtatacccaggagacccagcatcgcgtgctctgcctgttgtgaatgaggaatcaaaatggaaaggttatcattttcattagctaggaaagaacaagaccatacttttctccaagtgtaattacagcggttcactggcaacattacactgcagtaattagtctaaaggtgtatgtgagggcaggcttttgcacagacactagaaatattatttcagagttgaaggtcacagccttgtatttaacatgttccaggcagcttaggggggaaaaaaaaaaactaatttgactggagctaaagaaagacatttgacatttcccagagtcatacattcagaaaccagtcaggtcgaaaaattgtattttattttctacaataaaaggcaaaacttagctgcagaaatagcatgtcagaatattctgtaggataagcacagataaaattcaagtttattagaaccatgatgtaaatgattacaggaacttttgatatgtgtggggttttttttgtttttttttttgagacggagtctcattcttgtcgcccaggctggagtgcaatggcgtgatctcagctcactgcaccatctgcctcccaggttcaagcgattctcctgcctcagcctcccgagtagctgggattacaggcatctgccaccgcacctggctaatttttgtatttttgtagagatggagtttcatcatgttggctaagctggtcttgaactcctgacctcaggtgatccacccgcctcggcctcccaaagttctgggattacaggcgtgagccgctgcgcccgggctgatatgtgttttaatctttgccttaggaagagaatggacagaaaaaataattgtcagcagctcttaaagggaaacaaaatagtttctttcttccttaacaccattttcaagaaacaaatgtctatcttacacaggtccatatatctacgtcctttgtgaattttttgttactctatttaaatagtaatattgaaatctttttgtaactcagcatctcagaatagaaattgattgacattattttccaaagccacgtcaggctttctgtttaagtaaagtgaaagtaagaagaaaaaaaagttataaagagaagagcaactttacatacagtttatgtttaaagccatatatgagtttaagagaaaccttttgctttttctagtccaaagaatacttttgcaagcaacatttcttactgagttaaaagtattagcccaaataccctgatgtctttgtttaatttgagtaatgtctgcgtttcttcacacaattctgtttctctctttatatccttatatagccttgtagaatattgtttgtttcagggcaaatgatgacttagagtgtacttgaggaccattcattcagcaaccaaattctgttggaaaccactgctttttaaatgcaagtgtgtgttttatctgcactctctggccatatggttagaactgatgtttttcacaacttcaggcacttgggaaatttaagcatagatgtgacacaaatgacacagctagctgattatgtaacttactgaaaaatctaccccaaaattgaatttaaaaacattgctatttgtttgtcacagacgtttctctgctcaaggaaaagtcatacactgcagaattagatccgtgatgttgtaagttttccacagctagcaattaaataggaagcattgagtagtgggaagagttcaaagacttccctttcttctgccactgccactgccactgagcaaatcacccatcttgccagaccttagttctctccctgtgaaatcagagagattgctaagctccctccaacatcttactttctttgtctgtctaggggaatactgcttttattttctgcctttgtggttttcattaaaaaaaaaaaaaaaagtataagagcttttctcatatcttttcaacaaggcctagaaaattgtagcacactcattctttcacagctgggggccgtgtttcccagcagccctgagaggtcagcagtaatgcagggtcttgtagagacgtttcctgcgccttccttcactttagtgaccgagtcagagaaagcaagggatagttttacaggaatatttttataattcatttttcttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccataattcatttttcataaaatatctttaaataacgttaaaatgatgaaatgaagttctgtacatcctaggaaaaaattactttctctacttacatttgatgaataaattgtaaagtatgcctagcttgttaaagcaggtgccagaaccaacagccactttcaaaagtccatagaactgaattcagtaaaggaataagctctgaaggtaagaattgtcccttacttcagagagctacaatcaagttactacaatcagttactttcctgacagatctcttaaaaggcaaagctttgtaaatggaaactgagtttcccttggaaatactatagcatttgtattctcaacagaagcttttaacctctagcatgttacagaaattaaataaacatcattttatttaaccagccataaactatatgcctataaacaaatcagaaggaaaaggacatctttcttaggattacaagaaaatactttgttgagagttcctttttttttttttttttttttagagataggatctttctctgtctcccaggctagaatgcagctgtgcaatcatagctcactgcaaccttgaactcttggactctcaagcaatcctcctgccttagtgttccaagtagctgggactacaggtgtgcgccaccacaccctgctaattttttttatttttttgtagaaacgaggtcttgctatgtggcccaggctagtctctaactcctgtcctcacatgattctcccaccttggcctccccgaatgctgggattacaggtgtgaaccaccaccacacccagccaagctttgttgagattttggcaggcttctttaaggaaacttcaagacactcaatagcctcttgagacaccttgtaattgtttcctggcaggtactgtattgaaaatcaagttgttggtttaagtacaccaagaaggtagctgtaatttgcagagggctgtaagcatacatttactgtttaaaaagagagagagagagagagaacaagagagagacaggcttgattagagtacataatttccttcagctaattcctatgaaacctttggatgtgctgatccgcagcctacagatctaccttcaacaatgacttaaacttcacaattgaaagatctttaaatattgtaatccacctccccttcaacagccctactctcttctccctacttccgtcccacttctaccaacctctcatttttagatgaggaaagtgaaggcccaaaacatagtcaggtctctttcatctcaaaaataatctcactcagaccctgtgtctttgtcccctactgaccaatccatatatgtggcatctgttgatttcaaagaaccctcttcagacttttttcccttgggttctgctagaactgtgtgcttctgcttctgacctttcattgtccatccatcactttcccctttcttcctatccttgaatgttacaattctcttgacgccacccaccagaccattctttggacttagaatttcagttgtatcttaaacatttctgctgaacaattacattgtgctctgtcttagttcattttctgttgctataacaaaatacccaagactggataatttataaggaaaagaagtttatttggctcatgattctggaggctgagaagtccaagatcaggcaacccatttagtgagggcttcaactcagcagaaagcagaagggctttcaaagagaccacacacgaaaggcagcctcacattataacaccaggctctcatgtgaacttacccattccctcaagaactaactcagtccctggagaaagacattaactgatcctaatgacctaatcacatcttaaggacactgcctcccaacactgttacattgtcaattaaatttcaacatgagttttgtcagggacaaaccatagcaggctgccagtcacacattttatgagaaccatggttttcaacctcttccttacttgcaggattttgtccatttttcacagtgatgtaaccttttcctgttggtagtttcagctgttaggcaaggatctgtcagtgacggtgaggcagccatagaagtttgcttctcagatgagtgtagagtctctttaagacaaattctgatcccttctagtggactacctctgccattagcataatagataactgagtggtgtggtcttagagtcctgaagatatctgtagccttgccacttttctgcagatgccctgccttagttctatgactagaacttccttactcagatagcagaggcactgtttggatatggcaagccaggatgattactctcaattttgttatgtgagggtctttaaccacacacggctaccatatggggtgggagagacagcatctagaaagtgtaggggaagtggctcattttaaaaagaaatttgaggcttgtatatgtttccttagcccacaagttcctttgcaaccaaggtgaagttgcatcttccagaatgtcatctgaactcattcttccataacttcagtgttgactttaatattatttggaatagttgtttctcttaaaggttgtatttgattttcacttcagtgtgacttcattcattaaaaaatattgagggaagcatttattattttttgtttgttcatttgttgagataggttctcactctgttgcccagactggagtgcagtggcatgatcaaagcttactgcagcctccaactcccgggctcaagcaagttttatatatttataatatatatgtatgcatatatttattttaagcagtggggacggattgcagcagcttttgatcaaagccctagccttcctaggctcagtttttttccgtatgctctggagattttgtttagagacagagtctcactctgtcacccaggctggagtgcaggggtgcaatctcatctcactgcaacatctgcctcccaggttcaagcaatcctcccacctcagtctcccaagtagctgggactacaggcacatgtcaccatgcctggctaacttttgtatttttagtagaaacagggtttcaccacgttggccaggctggtctcgaactcctggcctcaagtgatccacccgccctggcctcccaaggtgctgggattacaggcatgagccatcgtgcctggcctctggagatgttttttttatttatttatttatttatttatttatttatttatttatttatttatttgagacagggtcttattcagtcaccaatgctggaatgcagtagaatgatcacaactcactgcaccctcaatctgccaggcccaagcaatccttccacttcagcctctcgtgtagctgggactataggcacacaccaccacactcggctaatttctgtattttttatagagacggggttttgccatgttacccaggcggtctcaaactcctggactcaagtgatctgcccacctctgcctcccaaagtgctgggattacaggcatgagccaccgggcccggccactctggagatttttaagggccttgccaatgagactggggacacaaataggatgactcctcagttgaggacacaaataggatgactgaaaaggtgtttgccactatgaattagtgcacattgcggttctcctgagtctctttggcaaataatagttaaatactcacctacaaatagttctcttatggttgattaaaagcccagctttctactatataaacatagcaagtctttttaactctgtatatattactgtcattgttatcatctccagatgaaatagagcagcccaaacatgatgggccttactctccacgttgattctaagaagaagaaagaagcagcatagttttcagtggctctacaatttcacattgttgttaatttcctgaaaacttgatgttaaatgaagtgtaattgcagatttccttaagaaccattgacagatacttatcctaagtcataagcaactcacactgtgaaatgtgtgcaaacattctaagttttcttctagaagaatatacttcagtgatacccaatattcaccagccctttttgataaacagagccattgaagctcaacatggaagttgggggaaatttctttttttacacttgatttttttaaggggattaatgttgccagaacttccattgtttttcagacagtgaaaagagtctttagtaagtgtcatctcagagaccttacaacttttggctaagagggctatattttgaatgagatagtaaactagatagtaaattatggtgtatttaggtactggcattgtatgatagagaggggagtttgatttgttttttaattgttaggtggtctatttagtgcagctgtgtttatgtttccttcatggtaaccgcctgaacatggtgacaagtccctacaaatgagaataggaattttaaaaaattatcttgccagtgggctttaatttgggggggtcataattattaagtagcattggtaaaaataatccccggcacagtcattcagtacagttgttttgctgtatcagacattttgacaaccttgtaaaaagagtaactgagtccaggcatggtggctcatgcctgaaatcccagcactttgggatgccgaggcaggcggatcacctgaggtcaggagttcgagaccagcctggccaacatggcaaaaccccgtctctactaaaaatataaaaattagccgggcatagtggcgcatgcctgtaatcccagctactcgggaggctgaggcagaagaatcgtttgaacccgggaggcggaatttgcagtgagccaagatcatgccactgaactctagcctgggtgacagagtgagactctgtctcaaaaaaaaaaaataataataataataatacttgataccttaagtgctgcatttcacagtagaataaacttggaaattatagaatttccttagaatagtcacacttctttacccattgttttggctgatttacttctttgctattaaaaatgggtgcctagatcataatgtacatcaattctgtggaaaattagcaattccatgtttttgctgtctttctctttaaaaaataataaatgaacatggggtcatgactgcagcaaagagacagttgcctgtgacagagaaaatgtatataataagtaaatagctctgtgaattactcagtactttcagaattgtatgtaagatatgaaatgtggaggtgcaaggtcctaatgactagttttccgaggcattttctttagtgttacatccctcataactcaaatgaatgtttattactattctttcatattgccaaaatattttcatgaatttggattagaagcagcttgttctggcttgttttgcaactttgtttcaggaaacaaagtgatatttagaagatttttgtatgtcatagaagctttaattatcttacttatgttgaaggagatcaaattctgtttcagagttatgtaagaaaataagagtttatactatgctaattttatgttgccagataattaatgtctttcaaaaaatttgaatccgtgatttgaacagggttcgctgttaaataaccagcaatgtagagtctactttaaattcaagaagacgctacttggtccagacctacctgggctagcctttatttttatttttggattcacaggtgtttacccttatctttcctttctttccctccccttctctccacagattggtgaaagacaacaagtgttagtaacagaagaatcttttgattccaagttttatgttgcacacaatcaattctatgagcaggtaagaggcacttcagtattcttgagttttctccaaagtgagaaagagttctgaaagtttaagcaaagggcatttaaaggggagagtgttgaatcttgtcacaacaaggctgttttatcgcttcaagccagccaggctaacatggactttatctttgtgacttactctacaatatgttctgtacaaaggaataggtgtatttagtctattttagttcacattaatctttgacaggaccagctttaggcttttgggcgtttggaaccaggcaattagcactgccagaattcccacaccctggcaaagcaggggggaaagtcctgctcagaccacaggaaggatgtctgcatgggcgacagcagcatgaaagggcagggatttcctctcgctggtacatcacccggacagtttttttagttggttggttgattggttggttggttggttggttttttagttttgtttagttttagcatctgtttttttaacttctaccttaataaaaatgctgggagcagaggaaaaggagtctattccttggactcaactctaattgtatgaacaactgtgcagaccagtgtgaggatcaaaccagcttcactgtgagagctttgaaggccatccctaggggcgcccccaattactagccctccttccctggccatctaagttggcctgcctttgcccaccgaggagcctgacttctgtttcagcatcagggtttctactcctccaggtgggagagcaattcaaaagtgactgaggaaaagagagtgcctctttcagggtcattgaccctggcaagggccaaggccagggaagagatgggatacgccctcctctcccatcttatggtagcctgtgtctcccatctcatgatagcctgtgtgggagactgtcatgggcgtacggagattttcactgatcattctggattgtattaaaatcaaatggagcttcctacttttttgcttctttcttatcagataagaggtgaaaatgtttgctatggatcatggctggaattagagcttgagaagatgctgaaggccaaggtggacaagtcggatgagggatgggcagaggaagcaggctgcctgtgtcagaaggcaggaaagcaggagctgaagaggcccccagcattgacattccccagggaatcatctcagactgggcagtgcgtccccaggaaacaggggagcttttcaaagcccagactaaacgtgctctgttcagtaccggtggagactgcagttgaggaagggctcccagcactccatgtctggcctgcatcgcttccccatttccccatctcattaatataccccagagggccattttcctattcaggccaaccttctgctcagccctggggaggagcttgattgcattttggttgcctcttctctctcctttctcttgccatctgggttttgcctcagcagggaacttttttcccttcattttaaaggcagtggcatgcctcgttagctgcttcctccaatttaaagcagtcgggctttttccaattattaaaactggaggaggggaaaacactgagcccttcattcagatcaaggcagcagatcaaggagggttatttttccccagaatagtaccaaatctcccagggttagtttggtctagagattttcttattttataaaaactgatttaaatgggctttttatatcctaacactaaagctcttttagttctttttgcctgccctaagtaattcaccacccaggtgacctttttcttctactttgatgaagcagtgtactcagtggtcataaaaatcaaactcagaccaagattcaattttgcctttcagagagattggctgtggaactcctggctctcatctgacttttctgtctctataactaagcatatcaaagattttctaggaattatttttctaaataagatgagttccagagatgaagattgtatctagatatccaagtattactggattagaactggtctatttattttggattctaacttgaaaagactggcaagtcgctgcagtgctaaaatagaagtgtaagggagacatcacacacacaagctacctgtgggtcccaaaggaagggaaacgtttgcttgaagtaaacaagtacttttatcaggaatctctagtggaaagagaccacctgacagtttcctgtgaacaagccaaagtacccttcagaggactggttctagatggaggtagattcccaggactgacaaacacatgccttttctaacagagcaagggaaatgaacggcagctgttagtttcaggagtcatttagctccaaacagcagtgtacagtgttattggaaggttcttttaaatgtacctccttctccctcaaaacacagcacacacatgcacggacacaaacacgcaggcctgtttgaagtgtcttttcaaaccattactctgacagctcacttggaaagtattaaaagtataaggctttcatcagtattgtctcggttttcctcattgcatggaatagccaaaagcaagatatcaaaggcctgtccagaagtggctggctgattgctgggggatttcccaggtctgccttccacgtgcctcaggacatcaggcacatcctgcactggaaaagcactgcccaggggcccaggagcccctcccaggagtgcctttccttcctgcaggctctgcagacccttgagcagctagaagatagagtccactttgtaggggatcccagaacagaaaaatgacattgagggacaatgaggaaacctggataattaggtatgccttcggttaataatattaatatatcaatttgggttcattaattgtggcaaaagtgctatactaatgtaagacggtaaataataagaaaactgggagttaggtatacaggagctctccatactatctttgcaataattctataaatctgaaactgttctaaagtaaaatgtttatttttaaaaattaagcctctgaaacaaatgtgtttaaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggtaagtaaaagatgctctcctctctaccctgctagtaaaacagcagctgtggaagcacagtgattccaggccatgtttctgttatcatttatagttccctttttatgtatgcatgaggctttaatcctttctgacagattgaaatctgaattagaaagatgtgtttttgctgatgccgatagctttgcttctctggctgtaaagagaataagctctttctgcttccagtttagaagcagggggtaaaagccattatttgcaggtgaaaatgttgacaccaaaagatgatctgatccagtatgtttctatgtcagtagatcctgagtggaaggggatgaagaaaggggtgttttcttgctttacaaagctgtttatactgtagtaaaaacctacagctgaacaggcactaaaccatatcatatatgcagttatggtgcctttcagaagggtgttagctggatatctactttagtcatgtggagtgaaaattaaacatttttttctttctataaaaaagtaacctgacccctattttataccttggtaaatatggccgtttgccaagctctctcacatttcattgagctacagttgtaaaagctgatggagtgtgaaatgaaaatgtgtatcacatttctaagcatcatttgatgtcctttctccaacacaattgttaagcgcttaaaaaaaaaaagcatataacagtgatttaacatatggaaaaaaataactgatatttatctggccatgtaattccgaaattgttttaatctgtgcataatcttgttcctcaaaataaattgcaaggacatgttcgttaaaataaagggaataccgcttcactctggcaatagtaccgcttcactctggcaatagcaacaaagacaatactattgtctgtgttctcactgactgtggcactggattcttgtgtccgacagcagtgataattcacatgtgcttcacaagtgcccatgaaggatctgcgtgcatggccgtctaacccgtactggaatggtatagaccagcttttgttaaaatcctaccaaatgcatcagcctgcatgatcaggagataactctaaaacttgataaacataaccattcatttttgctgtttattaaaaaaaaaaaaattgtacttgggggatagtatgggtggccaggaaggagcagtgtaacctggcatttaaattatattgctagagatttggcttttgatatgttagccaatactttgaaaaattttttaagaagtcagcttattttttgttttgttttgtttttccacatagtgtgttttacaaggttaattttagattgccacagtgaaaagggtttctcagcaagtagcagtagtggggaaattattatttcaaagactctgcctggtttaattccttcatgtttgcctcttggaaagggagtattgtaaacatcaccattgataatacataaacaaggaaatgtagtgtccctctattcgttccttaactatagtgttactgtctaaaagggcagttccgtttaaattctctggggcaccctttctactctcccatcctttcctctagcctagaaaatggtgttatcagttctaccaccagcccagctctgaaccagaatggcccaaaagtcccggataagatgaggaagccagttggttgctggtctgttagagcctctagaaatagtgttgtagcatgaggccagtggggtaggaatattgatttgggtatttacattaagagaaacagtaaggcttttgttggttcttgtttgtttgtttgttttgagagagggtctccctctgtcacccaggctggagtgcaatggtgtgatcacagctcattgcaaactctgcctcctgggcgcaagcaatcgtcccacatcagcttcctgagtagctgggactataggcatgcaccaccatcctggctaatttttttttttttttttttttttttttttttttttttgagtcagagtctcactctgttgcccagcctggagtgcagtggcatgcagtgtcagctcactgcagcctccaccccccaagttcaagcaattctcatgcctcagcctcctgagtagctggaattacaggcatgtgccactacgcccggctaattttttatttttagtagagacagggtttcaccatgtcggccaggctggtctcgaacccctgacctcaggtgatccgcccacttcagcttcccaaagtgctggaattacagacatgagccactgtgctcggccccagctgatactgtttattttttctagagacaggatctcgctttgttgcccaagttcgtcttgaactccaggcctcaaacggtcctcccaccttggtctccctggcatctaaagcaaaatactgtgctttggacttattttgtctcacttgacctcttttttttttttttttttttttttttcctgaaatgaagttttgcttgtcgcccaggctggagtgcaatagcatgatctcactgcaacctccaccttccaggttcaagcgattctcctgcctcagcctcccgagtagctgggattacaggcgtgcgccaccacacccggctaatcacttgacctcttttgatgaaattgatgagaggtacaacagattagaagggtgttatcaaaatgatggtgggaatgggtgaaggttatatgcacatttttagtgaaaggggcagaagaataggaaacttgagaaaaacacagttttaagatgctaagaacatcaatatttttatcttgtgctcacatgcagcctaatttttcctgaagaaaaactgtagatagacaggacgtggggtcagcaataccaaatccatgaccatgtaatagtttgaaaaattatctgaaagccatcatcaaagattgggatcaaggatttttttgtttaattccattatggaaatctatttatggaaattttatgaacattttcaagcatacacgaaagtagagagaatagtataataatcccacatacctattacccacccttagcagtcatcagatgacagccaatcttatgccatctgtgttcttatctacccctattcccccaaccctgattattttgaagaaaatcccatttacattttatttcatctagaaatatactagtaaatacctctaaaagataaagattccttttacaaacataatcccaatatattgtcaaattttaaaatcattacccataattgttattggctaaatactccatacctactgctaggaccctaagtcaacatttatggcgtgcttatcgtagccaaataccatgctaaatatgctacatgtgttcactcatatcgccctcataaccctgagaggaaggcactattattatccccatttcacaaataaggaatctgagcatccataattcaataaatagcttatctggagtcacaaaatttgaaggtagaagagggaagccaggatttatatccccactttcaagcctttgttttcgtttttgtgtgttttaattgtggtaaaatatacgtaacataaaatttcctgtcttactcatttgtaagtgtatagttagtggtgttaagtacattctcattgttgtacaacccatctccagaactttccatcttgcaaaactgaaaccctgtactcattaaacaataactcctcatttcccccttccctcagcccctggtaacttctaatctactttccgcctctatgaatttgattacttttggtacctcatatcagtggaatcatatgctcaccagtgtttgtctttttgtgacttgcttatttcacttagcataatgtcctcagggttcatccatgttgtagcacgtgtcagaattttcctccttttcaaggctaaatactattccattggatgtggatgccacatttcattaattcattcatccattggtggacatttaggttgcttctaccatttggctgttatgaataatatttgctatgaacatgggtgcacagatatctcttcgagtccctgctctcaattcttttggatatttgtgcagaaataagattgctggattgtatggtcctctatttttaatcttttgaggagctgccatactgttttccatggcagcggtaccattttacatttccaccaatagtgcacaagggttccagtctctccacattcacaccaacacttattttctcttttgttttgttttgttttgttttgatagtagccatcctaatccgcatgggtcaagcctgttttgttttgttttttttgagacagagtctcgccctgtcgcccaggctggagtgcagtggcctgatctcggctcactgtaagctccgcctcctgggttcacgccattctcctgccgcagcctcccgagtagctgggaccacaggaacccgccaccacgcccagctaattgttttgtatttttagtagagacggggtttcactgtgttagccaggatggtctcgatctcctgacctcgtgatctgcccgccttggcctcccaaagtgctgggattacatgcgtgagcccccgcgcccagccttttttttttttttttttttttgagacagagtcttgctctgtcgcccaggctggagtgcagtggcgcgatcttggctcaccacaagctccgcctcccgggttcacgccattctcctgcctcaacctcccgaatagctgggactacaggcacccgccaccgcgcccggctaattttttttttttctttgtattttagtagagacggggtttcaccatggtctctatctcctgaccttgtgatccgcccgccttagcctcccaaagtgctgggattacaggcgtgagccaccacaccggaccagtcaagcctgtatttttaagcccaggtccatactgccttgcccattttaattgcaggagtcttattcgataacttctggacaccagtttctttttgtataccagagtaaacttacactggatacaaaaaaataataagtaagagagagagggaaaaaaatgagaaaatgggcagttttaattatcttctctgtgggttcagttaaaaatggcattagagatctgtctctcttaggaatatgcgacaatgtgaacattactgctgtctgttttaataaaggctaactagttttactactaatgttctttcttcttgtctggcctatgttataacacatcgcttgaatcttaccatttctaagattgattcttaagaagtcagaactattctttgcctggtacgagatagaaaagaacattttctcttctaattttaaacttatgaatagtttgattgcaaagttttttttcattgaattcattcttagtagtaaaaattgctttaaagaaagaagtagagtagcatcgtggaagattgaaaggatctggagtctgtcaggtttgggttctaattacagtgacagttgctatgatcaagtacaactttcttgactcacagtgtcttcatttgtataatggagctaacaactgatttgcagaggattaagttaaatcatgtagacaaagtgcaccatgcatagtaggtatattaaatattttaaagaaagaattcagtaagtatcactttaaaaagcagtggtttcctggcttttattttgatttcttttactttaatttcttttttttttctttttagacagagtctcactgtgtcacccaggcgcgatctcggctcactgccaccttcgcctcctgggttcaagtgattctcgtacctcagcctctggaatagctggaactacatgcatgcaccaccacacccagctaatttttgtatttttagtagaaacagggtttcaccatgttggccaggctgctctcaaactcctggcctcaagtgatccacctgcctcagccttccaaagtgcagggattagaggcgtgaggcaccacacccggcctactttaaatttttttttttttaagtactttgcagcctgatgcagtggttcacgcctgtaatcccagcacttcaggaggccaaggcaggaggagtgcttgaccccaaggtttaagaacagcctagcaccattgggagacttcatctctataacaattttaaaaattagccgagtgtgatggtgtatacctgtagtctcagctacttgggaggccgaggtgggaggatcacttggccccagagggtcgaggctgcagggagccactgcagcccagcctgggtgaaagaatgaaaccttatctcaagcaaaaaaaaagtactttgcgttcatggatttcactgtacattatagtatagcaattaagaacatgaattctggattccgattacccaggtttgaatcttgattctactattacaaaaaatatgatcttgggcaagttactcaatgtccctccacctcagttctccctatgtaaatgagtgatagtactacctgcttcataggatatacatggaaatggcttagcagtcaataaatattgactactattttcattattaatttgtggtgcatgccaaggcattattttactttaacttgtgaagtaaaagttgcccaatatcttatcatttcaaatgttgtattcatcagccatagatttctgacaatggcagatgaaaccagaccaactgctgagattcctccatgagaatgacaaattaacagaaggagattccaataatactactacagcgttggccattcttacggacagacatttcttcctcttactctttatgtctttttttttttttaaagagaatattctagaatggaggcctggacttaccattctctttcttacaagttaagagaaggctgccccagggtgcctcagtgccacctgtttctcatctattgagactttgatcctgagaatggattcacttgagcagttagatagctcagccctgacacagccgaccgcgcttggaaaggaagcagaagttttaaagggtggcatggtttgcttcattaccagacaaaggccagcaggatattcaggtgtactgagttttatgtacaaactatactatattctcagagctttgacccttggaaaaacacagttaaaatgttttcctctccatctgacattcatttccagaaccagtgaagtgaaagggtctattagttcaaggccagatttgaaagcacatgaaaactacattcatgaggttaagaaatggcttaataattaagttaaaacacttgaaagtgggtctaatttcagacaggtcagctaaccgtgctagaagcaaatgagggcgtgtttcttcctatttttccttccacccccaagataactggctcccaagcagttttttctgttccttttttttcttactaaactttatgtgagactaaattcttcatcgctgctaagttcacgtcacaaacaattaaaaccatagtacgtttaatattttatgcatttttctttcattttgtatcttgttagtttcttttacagactggttaggacgtatttgagtttcacagtctagatacatagcttttattctatgctgctgagctatattttattgaccgttgcagctgaattagtatgactgtcacttcacactgtgtttagtgtgtttacaataccttccgtgtaccaatttgagtaccatccaaagtatcatcagagcaagctgatgctaaacaattagctttcatttcacttgcatcactaattgtgcaatcactgatgataattctcttcctcctgagggttgtagctggagcatcgtgagggaaattgcatgcatcagggaactaattgtgccttgataataataatagctaccatttagtgaaccactactatgtgcttggtattgaggctctttactcgtattacttcagtttattattctagcctggcctagggcagctagaacacgatgaagttctttatacagctgtacacacccacatagaggcatcataggatgggactgagcaggcattttccccacctctccatcctttgtccacgttcaagataggaggcagaaggagcagtgagcctgggacaaagacgtggaccgacttccctagctaagcgctaaggaaaagaaccaggcccccgagcctgaattacttacatatgcaacatgcaggtagcacctggcctcttataatatgtttcaatgtttattatccaggaacggaatgaaatcttagagatggaaataatgaatatgggcttggtcttcgagaagtttttggtcttggctgttcctctggtaatactgctaatcaattgtgaccctggtagggagggattggtgtgagggaagtggtcttgtataggtatgctagctcacctgtgcgacataattactcctgtggttaaagttttatggataattttcccaaatctaaaagggatcccttaagagcaaaagggattctttatcatgaaagcagtgaatggaaaaaaagcctccttaggagaaccaaagatatatttcagcagcagcagaacctgaaaggtcatctaagcccagccacctatccctgcaggatgggactagggaggttccagaagaccatgatttcctgtgatgatttgaacccaggtgttgggaaccactcttccacactcacattttcactgcactatttccccttcacatgtctttaccttttcactcagtcaacaattatcaatgacgagtatgacactgtatgcatcaaagaactaattgtgccttgataatatctgtctgtgtcaggactgtctgcatcagtcctggtttatacgtgttgtaatagtattaataatatgcccttattccactcctcaaagtattctagtttggatgataaattatatggtcatcctataaattccaaaagttgagccagcgctgtgtcaagcactgcttgggatacagaagttggagataccatcctgccctcaaggagataaagtctagttgggaagagaagatatgtgctgctgtggtctgaatgttggtgtcttcccaaagttcagtgttgaaacctaatcactcatgtgatggtgttaggagctggagcctttgggaggtggttaggtcatgagggcggagccttcatgatgaggattagtacctttataccatactaatgaaggctccagagagctgccttgacccttccattgtgtgaggacacagcaagaagactctgtctataaactagaaatctggcccccaccagacaccaaatctgctggcaccttgatcttagatttcccagcttctaaaacagtgagaaataaatatctgttgtttaaaagctacccagtttatggcattttgttacagtcaccgaaacgaactaagacagtatgtacatatgaaacaaaatctataatatgtcaaatgttaaattggttggcgttagatcataagaagttggaagataggagatctctgatgacttgaggtatcaggaaatgtatgggtcaggattctttgcagacaacagagagcagtttagttaaacaggaaggaatgtatgaaaggatgctagatggcccacagaattgttagaagggccagggaccagaatctttgctgagttttccagaaacaacacccagaaccacacaggagcttctggtaagaggtgtcgcctctgctccacctcccccagcaaggcagaggccccatgccccatctgcttcctcatgaagcttcccagtcaatgtctcacatatatcacatctgactgtggaacccaagtctcacatttacaccctggggacaaaggaggttggaaaatcatttttggcatctgtagtcatggggaactgtcaatgtggagagggttttcagacaacttctactacagagagtttcatggatatggactttgaaggtgagaagaacttaatcaggcaagtaaagaaggaaatttttctcactgtgaaaggaaccaacgcaacgtgacagaatgcacagactaagaagttgtgggcagttggaaggcacagggaaatcacctttagtataaagactgggacctctgggttttgaagtcaaataggatttatacctaagacattagacaagcacatatattcgtccaagacaggttaggctgcgcttcggtaacaaattaaccctgaaatctcagggctaacataacagaggtttatttcctgctcacactgagcatctaagatgtaccatttagtttgtagtttagagtcaggtagttgtctgctccacacagtcactcagggacccaagttgactgcatgtctccatggtaaggaaagacgattgccggtgaaccaggctttttactgcctcagcacaggagtggcacatggtatttgtattcatattcattggccagaacatccacatggccctgtctaactacaagagtctagaaaatacctacttttgttttaataagaaggagaagatatgggtgaatactagaagtttctatcatgcatgtgggaatattttgttttgctttgtttttgagacagagtctcattctgtcacccaggctctggagtgcagtggtgcaatcttggctgacttgtagtctctacttcccgggctcaagtgatcctcccacctcagcctcccaagtagctgggacttcagacatgcgccactgtgcctggctaattttttttttattttttgtagagatgaggtctcattatgttacccaggctggtctcaaacacctgggctcaagcaatgctccagcctcagcctcttagagtgctgggattacaggtgtgagcctccgtgcctggctacatgtgggaaagtttttgggcatgagcatagtatagtgaaagtttctatatgagggaaagcccatgaaagcaggccccgcctgactggtctgcccacgactggctccaggccccagtgcagtgcctgtttcatggttattgaatgaacttggctctcggcgatatgcagggtggaatggatgggttctccaccagaggcagggaacctacatgataggttgaaatcctctgttactccagctgatgaggacattaatatattcttcaatggttaaaaaaaaatcacagtcaagccactcaacctactctttgaagtcatttgacatcttgataagcagattgcaaaagcccctttttaaactgatagtaatcttgcaaatggaaattcttttcatgggaactatgaggatgagtactttagagcgagttgcttctaaccataaattgtagtttcctagtttcccttctcactttctaatgatgaaagtgacagcctatctctcctatgagactcagagtgtggatgttgcattgtacctaaaataatagaacattatttttaaataaataaaatagaatatgttcaaagaaatagagtgtgtttgttttctaacatagtttataatgtttaaaatttttttcattatttttaaatttttatgtatttagggggtacaagcgcagattgcttatatgcatgcaagcagtgttttaaatttaaagggctttggggaaacaaattttctcctgtccctctctctcctgaatgcaattctataaaattattgagaaacagaaattttcaatccatatatcaaatcaggtatctagggcagttttctgataggaagccaacctaaaaatttaagatgtagcaccttgcaaatttgccaacccctgagaaggaaattcaaaaggcaataaaggcaaagaaccatcagccgactttatcaagatcagcattttcccttccacaggcccctggctcccagggcttcctccttgaaaacatccgttttgaaggaatagagtagcccttacgcacatcaggtcagaccgtgggtttggcattttggctctgttccttactaattgtgatcactggtcacttaccctctctaggtgtctttcctcatctataaattgggaggaatagagtccatttgataggatggttttgatgtcgaagtgagataaagcttgggaagccctgaacgctgcctgacacgtagaagtgatcagtgaatatgtgatgtggagtggggggcatggtgatagtgaagatttacttggggcctggttgatcaagatactaataatatctcgttcatgaacatggatgatgttttgccctaatcacctatatgccatgagacgaggaattggtcattggtctttttaaacatacagtctttataagcagcaatagcatttgtaaaggatagctgcctgaaataaattctttgagtttttcagttcccccttttcactgactttgagtagctgtttcttttgttatccttcatgtgagcacagttcctctgaacaatcacaaagcatctatggtgtaagatagtggcattcactacaggtcttcttctcttaaatattcttgtgggaagtgatttcccctgccgtgtactatattatctgaaaatgaaacaatctgcctaacgagtctccctgtttctaccctgaatataaaccagattgtgtctctctcctcctcaaaaccatctagtgctccatatgactcagagcattccgtatatagccaacagaagggaaaccagggactcagatacttatatcccaatattcataccagcattattcataaataacccaaaggtggaaataaccaaagtatctatcaacagatgaatggacaaacaaaatgtggtatgtagtagaatggaattttattcagccatagaaagacatgaagttctgacacatgctacagcataggcaaatctggaaacatgatgtgaagcaaaataagccacaccagaaagggcaaatattatataattccacttatgtgaaatattgagaataggcaaattcatagagacaaactaggttaaagcttaccaggagctgggcgtggagatggggagttccttaagggttacagagtttctgcttggggtgataacattttggaaatagtagtaatggttgcacaacatggtaaatataattaatgccactaaattgtgtacttcaaaattgttcaaatgttattttatatatatatatatacataccatataaaaatttttacaaaaatcatctaaggtttcccagcatgttcagaatgaaagccagagaccctacaacagcctcaaggatcaaggtcccatgccttgacctctctcccctcgagaacactggcctccatgctgctccttgaacatgaacacacgaggtctgctccctcaggagggcctttccaactgctggtccctctgcttggaatgcccatctcttagatgtccctggtacatacttcattcaggtctctgctgaagcaccagcttatcagtgaggtcaccctgggcagtcgtctataaaaccccaagccctcaccatccaacacaacctagtacttcctattcttactctactctattttctccatggcacattttatcaccagacatattaaatatttacatgtttcttttgcctctagttaccaaaattgaagccccatgaatgctgagactttacttcattcacctttgtgtccttaatgactaggatagggcctggcagggagcaaatgctcagtaaacgtctgttggatgaatgaatgaatgaatgaatgaatgaatgaatgaatttgttccggagatatatgtataccccttactgaaaaggactgcaagaccaaaaagctggttatcctagatatgggttatcttttgccatgataaatgccctatgacaaccaaccacagaactgcagtggggctcagctgatctcagcctggctcactcacacatctgcagtgcactgtagggtagctcagcagctcttctaagcttggtggggcttcctaaaatgtatggaggttcagcaggcatttggtggatctagatggcctcaactgggactccgtgggtgaatcagccctgctccgcatgcctcatccttcaactggctgacctgagcatgttcccgtggtaaaggcaaaggaatagcaaacagacatgcacaagtgcttttcaagcctctgcatgcatgatgtttggtagcatcctgttggccaagtaaatcacatggccaagaccagggacacactacagagttatgtgacaagaagatacagatacaaggaggtataaggaattgggaatattaatgtattcagtctaccacaccctatgaaatcttggtgtttttgcctgtgatctgcgcaactttcctcctccttttctacgtccccagaagacatcacattcagtttcaacctgagatctaatcctttcagctctacaactcagtgtcttgtttttaggtagtgagttgtagagctggaagggttggatctggtaaaaagaatctgaaatctaaacgttaatggaagctaagggaccttgtcatagtcttttctatgaggaaatgtcaagtgctctagatatccggtgcttttctctgaggtacaattgtacccagcaactcaacagtatcaccctggggacctgtggtaggcagaataatgccccccacttcaccccccaaaggtgatcgtgtcctaatccctagaacctgtgaatatgttagattacatgacagagagaattagggttgcatatggaattaaatttgctcatcagctgcccttaacataaggagggtatacttgattatccagatgggcccagtgtaatcacaatggtccttaaaagcaaaagagaaaggcaggagaatcagaggtcagagtgataggaatgctgacttcgaagatggaagcaggctgtgagcctagggatgcaagctagaaaaggcaaggcaatggattctcccctacagccctagaaggagtccacatcacacttgatttcagtccattgagacccatctgacttctgagttccagaactaaaaaatggtaaatttgtattgttttaagccatgcagtttatggtaatttgttaccgcagcaattggaaactaattgggaacttatcagactgattttatcccatagaatccatgtaaaaaatgagaaggtgtatattggcaggctgggcatagtggctcactcctgtattcccagcattttgggaggccaaagtgggaggatcacttgagccaaggagttcaaggctgcaagtgagctataattgcaccactaaactatagcctggaccacagagaaagatccggtctccagaaaaaaaataataataagtgtgtattagcaaccaagtggctgttcatgtcccatctattttccacattgaccaatcattttaagaaaggtgtggtggatgggtggggaacacctaaggcattgacaggcggtaaaggaaacgtgctaatggagaagagggaggttagcgactggggcccatctaagaaaagaaagagattcttaggggactgcttggagagttaatgtttgcaggaagcccacccacaggtcttgaacccccatcctggaccactttttcttcctttgaccaacccttccccaaccctcatctccagcccaaatcttgctagagcttctaacttacatcacatcagctgtgatgaggacttggtgtggccacttatctgcaatcatttctctagtctgggtgccatacctaggagtggcattgctgggttggccagagtgtacagctcccaccttaccaggtaatgccctcctgtctcccacagtggctatgttaatttctgccattaccagcagcagtgtcatagtgttctggatcctccacattctcacccatacttgatattgctcattttttttactttttccaacctggtatatgtaagctggtatttttgtatttttaacttgtatttctctaattacaaatgaggttgagcattttttttaaaatatatttattggttttatatatatatacacacatatatatatattcagattttctcttcagcaaagagtctgtataaaaagtcttttgcccattttcttctattggacgatactttttcattgatgtttaggatttctttttctttttttttttttttttgagtcagggtcttgcactgttgcccaggctggagtgcagtgatgtgatcattagctcactgcagccttgaaatcctggccttaggtgatcctcccacctcagcctcccaagtagctgggactataggcatgcaccaccatacccagctaagttttattttttattttttatttttatttatttatttttatttatttattttttaagatggagtatcactctgtcccccaggctggagtgcaataacacgatctcggctcactgcaacctctgcctcccaggttcaagcaattctcctgcctcagcctcccaagtagctgggattacaggcgtgcactagcacgcctggctaatttttatatttttagtagagacagggttttgccatgttggccacactggtctcgaactcctgacctcaagtgatccacccgcctcggcctcccaaagtgctgggattacaggcgtgagccaccacatctggctatttttgcagagacgggaactcgctgtgttgcccaggttggtctcaaactcctcgcctccagcagttctcctactttggcctcccaaagtactgggaccacaggcaagaggcactgtgcccagctgggatttctttatgtagtctagagtcaattatatgtgaagcaagtgtctcttcccagtttgcagcttgttaacctctctggttagaagttttgttcttttgtttagaactttgtatatttttgtgatttgtttaagaagtatgtcctccctaccttgtggttagaaaggttttcctcccatattgtcctaaagtttttctagtttttccttagccaggtaaatatttaatatatctgaaattgatttgtaaacatggtaggtaggggttaaatttcattgttttatctgtgtataagcaactgttccagaaaactttattgaaagtctgtctttcctattggtcttcaatgcctctgttatgaatcagatttctaagtatgtgtgaattggtatccagccctctacttggcaactttttgtattagttatctgttgctgtgtaacaaattacttcaaaacttagaaacttaaaacaacaaacatttattacctcacagtttctgtgggtcagaaatctaggtgcagcttctctgggtgcccgtggcacagtactgctccttcggctgcagtcaggctggcagccggggatgtggccttagctgaaggcccaactggggaggatctgcttctaagctcacttttatggtgatggcaggattcagtttctcatgggttgttgctttaaggtcttagtccttggctggctattggtcagaggcctccttccattccttctcctgtggacttctgcatagtgcagctcacagcatggcagctggcttccctcagagcaagcaagcaagcagagagagagagagatggaagctacagtactttgtaacctaattttggaagtggcatccatcatttatgttgagcattagaagcaagtgagtacattcagaccatagccaaggggaagagattacatatgggtgtgaataccaggaggcgaggctcactggggatcatcttcagggctgcctaccatacttttatagtaacataagtaattaagttttttaatattaatctaattttaagtgcctttccataggatcattattttttacttttaaaaactatattcaaaatagaaagggagaatgggcatgtcttggaacagatttttggaagaaagcataatagaactttgggagtgataggaaaatatgtagagatgtgatctttcttcagatggttgggttcagtttagtgtaattatagtaagtacagtcatctcttggtatctgtgggggattggttccaggacccccgatgggtaccaaaattcatggatgttcaaattccttatataaaatgacatagttttacatataaactacccacattttcccatgtattatctctagatgacttttgatatctaatacaatgcctacacatctcttcagattcatggattcaacatagtattcagtgtgtgacaaattcaagttttgctttttggaattttgtggaatttttcccccctgagtgttttctatttgtggtcagttgaacttgtgggtgtggaacccacaaatatggaggaccaattgtataaaccatgtaatttttcctaactagtttatctgcattttccaagctgcaaaactatcatggtgatatgtaggaaacattttacatattagcttctcatttatgagattctttgagatagagaaaagcacctgccgtctcctttattcgttttatgcagtttatagagctcagtgatgctgaaaccgtatttccagtgtcactgaaaatgatactaagaacaggatgagagggttgtattgtaataacagctaacatcacacatgtcttctttttcatttaaaatacaaaccaaacatctgccaacacactttcatggttacctagttggaatgaaacccttaggaacaattattttgagttgaactgatgacttaaagatgaagtttaatacacccaattgttatgtttgtgaacatcctggctcagtgcttcctgtgtgcgctgcatggaatgagaatggtttcgggtgtgagagactattgaaaagatttcttcatcagtaaagcatcttgacccaattcaccttttatttcttcaactttgccacacctgtggggcagctttcattcatactgatgcttatctccagccactaatgaggaatagatgagttcaggtttctactactatcatgaatgttgggattacaggcttcatggttctaagtgtgcctcttggttccttttttatgttaaagctcgtgcgtgcgtgcgtgtgtgtgtgtgtgtgtttgcgagcacatgtgcacttgtccatatatcttaggctgatatttagttagcagaagagacttaaatgacaagttctagaataatttccaaatttccaaactttgacccagtaaataactaacttgtgttttccttatgtgcagttactaagagaaccttttctacgtacctctctttggagaaaaaaatttaaacaatgaggaagcagtaaagataaatgtatctccagctaaggtgccagatctctgatagcataccttcttggcagggcttactttgtggaattggagaagttatgtataaacaaatgccagcgcaccactgttggcaaagatttctatactgtgttattaattctagatctggttcttctgtcctacaccctccccttattttggtaaatgtaacaagccaaaaattaggaaactattataagctcatttgagtgaatatttgttactaagccaaagattaagacagctaaaaatgaaggtattcagatagaagcccacagctggagtgtcgagaatgcattacaaagcctgaggggccacctttgctcattccttcttatgaaggtctgatgcagcagttcctgttagggatgcttaccttaggaggtgcttcctgaagtttatactggagagattaaaatataattgtgggccaggcacggtggctcatacctgtaatcccagcactttgggaggccgaggtgggtggatcacctgaggccaggagttcaagaccagcccagacaacatggtgaaaccccatttctactaaaaatacaaaaattagctgggcgtggtggcacatgcctgtaatcccagctactcgggaggctgaagcaggagagtcacttgaacccgggaggcggaggttgcagtgagccaagatcacaccactgcactccaatctaggtgacagagcgagactctatctcaaaaaataaaaataaaatgtaattgtgatagagatagcttataattttgtattcaataccagaatttttttcatggaggggaaacaaggtctttctctgtcacccaggctggagtgcagtggtgccatcacagctcactgcagcctccacctcctgggctcaagtgatcctcctaccttagcctcccgagtagctgggactacaagcacatgccacaatacccagctaattttgtattttttgtagagagggggtttcgccatgttgcccaggttagtgtagaagtcctgggctccagcagtccacccaccttggcctcccaaaatgctgggattacaggtgtgagccaccatgcccagccaatttcaagattcttttctatagtatactgtactgcataatgtatgttttaagattgtttccttgcattggtcacatatttggtttcagtaggttttctgcagagcccatatgttcaggcatggtggggggaaaaaagcctgttctaaactctaatttatcctgagatctgagctatcaaacaattttttcttcatccctgttagattgcacttcaagctcttaacagtgcctctgagccatgagaaaaatttacacatgagaaatgttttgaagccattaaagtaagttcagagcttaagagttgctttcacatctcttgagtcagatgaaatgcgggcttacagagagtaataattaggtgatgggcagatgccaagctttgttttttgatacgattatctctgtctttcatttggcaccgttcaagtctgcaggttgggcattctgaaagagagggatcactgagaccacacaggggcacatcagatctgttcctttggtggacgtcaaggcagaattactcagaatataatctgaaatgcatttgatcatacagtagatagtttaataatttatgttcagacttattagcaaagccttgtgtttactctgctgtcaccaaaataagataaaaacccacccgtgatattaagattagacagttcgcatgtgtatgtatgtgtgtgttcaagtttaaaatttttgttcatgattgtaatgacctgatagcaattacacatttggggtgaaaggggtaagggaaaaatgtcgcatgaataatgtctgatgtagaatttctcattcccagaattgaaacagaaaggctgacagtattgcgctctaattgcgtgactgtgtgaccgaggtcttataatggaaatgttcttccaaaagaaatggaaaggagcgattaattccaacttcaatttgttgatcctgttacattccagtgtacctataatgctgatggactatgcatacaacattgttttaactgacttcaagataaaatactggcatttttggtttggagataattgggtacagctacttatatgatattaaagagctcccaatttggggaatgtctagaagaataaaggagaaagatagcttggcacccttaatcccctgtatgtcctggtatctggtaataacatgaagcccagggacagggttgtcttgtcaattcaaggaagggagctggcatgtggaatgtgattgcagggccctggtaacacctgcaggtgtcagggacagaagaactcatttggaagctgcaccgcaagatgggaagacaggtggcaactctcttacagggatatcttttatttgagcagaaccagaccaactgttcctcattaaaacacattttgcaacgtgttctcatgtgagcgcatcaagtgtgtgtgcatgtgtgtgttcagagcatactcagcgatgtgccatctacaggtcacaattacaaattcgcaacgtggctcagaactgcaagacaggtagcgtgaaatgtctctgcataacatgcggctgacttttctggaatggcctctgtagggaaactcaaaataacaccattacctctgtgaggtgcaggggcaagtaaaatggataaaatctatttggtgggactgttgatcttgatagtcattgtaataactatgcagtgcccttgctctttctcatttgtatggaattatcaatgtatctcagaagtgttgctgtggggctgtacttagtatgagtaaagccaggccactcatctgcttcaccatttatactatcagaaatttgggcaagtgacttaaagagagggttaactcctattagctacttcactgagtagtctgaaggattagagagcacttagcgtcctgctgggcacatggtgaatgttctctaaatactccttctacttagtattttcacatagagcctatcctctgcctttctcgctgaatccttgtgcttctggttctccagccaggtaccatattacaacttatcaatattttgtatgagaaggaagaggacttggaagaaaggcctctaaacaacatgacttccttccattggaagcccaagcccatccagcccccaagaagagaatacttgtaactaggtgaagaaatgactaaaggaggcaaaggaataagtagaaatgcaaataccagttcagaaaacattaactgatcatctcttgggtgccctttccctcggagtcttgtctcttggggccaaaagacctgtgaggaggacacatctgaaggccctggaggcctgtttcctccccattttcttaggaagcagctagctcagcaagtctgttagctcagcagaaggaaaaggccttagcagaggctcggccgtggaggtttgctgtcctcttcccccaggaaacttcacggtcagccagccacacagtctcctagaggcgccctatccctctttccttgtaaacgtgtagagcatcacacttctgtcagagtgtgttctcttgggcagctagtttagctctgcctgaactgagtacgctttctggtgggatgcaagcttgggggctcacatatgtcaggagtggcaggcacagtcatgtcccccacccaaagatgtccatatcctaatcacctgaacctccaacgatgttaccttacatggcaaaaggaactctgcagatgtgattaagataaggatcttggaatgagaggattattctgggttatctaagtgggttcaatgtaaatcacaaaggtcctgataaaaataaccctatgatcacctgaggtcaagagtttgagaccagcctgaccaatatggtgaaaccccatctctactaaaaatgccaaaattagccaggcgtggtgacacgcgctactcgggaggctcaaacaggagaattgcctgaacccaggaggtggaggttggagtaagccgagattgcgccactgtactccagcctgggtgacagagtgagactctgtctcaaaataataataaacaataacaataataataatagtaaccctatgctactggctttgaaaatggaaaaaaaagggtcacaggccaagagatgtaggcaaattgtagaacctggaaagggcaaggaatcagattcttccctggagcctccagaagaatgcctcccagccaacaccttgacatagaacttctgacctccagaattgaaagagaataaatgcatattgcttcatgccctaggtttgtggtgttttgttaaagtagcaatagagaactcacataacatgctgtttctctgctggtaaggtttttccctagtaaccctatttcatatttatactatgtagtattggtgatgtatgactccttgtcccatttacttgtcagtctaataagaaatgtaagaataggtaaatggcagttcatatggaagggatatttgctcctatataaaatgtgaatatatggtagtaagtaacaggtagcaatggcagtatgcattcagctaacactggcccctcctaggtaccaggtcctgggcatctattggagagaaaggccacccctgctcagaaggagcacgcttagggtgatgcaggagccaggatccagcagggtgctcaccactgttgacacgcgccatgaggagggccagctgacaagacgagcaggcccacacggggtgggcagtggttgagagaggttttcctaaagcaagtcctgtcttagttgaggcctgagcaagcagtaagtagaggaggcaggggcgggtgatggttttagttcggagctttccaggaggtgcactccaccggctttaccatctcagagcccggggagtaagaggtgctgacttcacaatggacgtagcttcttcctcatgggttagtgaggaggtgcaaggcaggacgctgtcatctcagtgttggtagtaagtgctgtgggaggctctggccttctctgtttttcaagctacactcctgtgacgtcaccgtcacagcagcccttattgtgaaccttctgtattccaggcactctgcccggctgtgggcacattacttctattccttctgataacttcctaaggtagatggctttccttcttcacagaaaggatagccaggcttagagagtttaaactacctgcctaagatcacatggctgtctgaacctgcgttcagtttggtctgccacaattcaaaacccatgctcattcattatagtgtgtgcctcttaatggtatacataaggaacaaaaatagcacgggtcaattctattttagaagcaaataaaataatgactttgtaatttacaaaaagaatttctgaggacgtttgcgtttttcattagaaccacagaataccatggaataagttaatctgaattgacatttaaatgttcagaacacttaatctatatatatctaatttaatcctcataaaaaccctatgatgcacaaatactagcagtatctccattttacaggtgaggaaatggaggcaaaaagaggataaaatttgcctgagaatcctcagatggagctgggattagagcccagagctcgaggacttactgctcctagaaccggttccatctgtgccttgtggcgtgaaacatgctcaagttaaaagcatctctttcctttccccaacaatacgtgcacaactgctaaagacgaaggaaatagagatagactgttgttatcatcccaactgtctgtatttatctttaactgattgaaatctgatccctaaagtttctgaacatgaaagttttttttttttttttttgaaattttggtatccatacttggttctgctttaacagattgattactttgataggatttgataagctacacttttgaaaattagtagattatttttaagagttagcaagtaagtagatttagaaattaatcaagggagcagtgagatttacaagggaagacaaacccatgttaatcaaagttaacacagaatgcacgatgggaattttagtgcgccccttagtctttattataacaggataaataactccatttaacagataaataacgccttttgcgtaagcaaaggtcatatcctgccttgtttcaaatttctgtttttaaaaaagcatttctgagtagaatttgagttcttaaaaattgtctgagttgatgttccagcttgttttttttgttgttgctgtttttgttttgttttgttttgtttttgagatggagtctcactctgtcacccaggctggagtgcagtggcgcgatctcggctcactgcaagcttcgcctcctgggttcacaccattctcctgcctcagcctcccgagtagctgggactacaggctcccgccaccacgcctggctcattttttgtatttttaatagagacggggtttcaccgtgttagccaggatggtctcatctcctgacctcgtgatccgcctcggcctcccaaagtgctgggattgtaggcgtgagccaccgcacccagccccagtttgttttaataagcaataacattattcgaatttggtgtatgatactttgagcgatgcagatatgtattgaatttcaggaattgacaatcttgataaggttttaaaggtttagggaaggtctgagcctctgtttactttctagaactacgcttgtcgtgtgtgtgtcgactttttctatcggctgtttataatcacttcgcctataagcactttttattacattattttctattcatgatccctgctttcaactggtatggttgtacatttacatgtttgagcatcttggactttataagatctcatatttcccatatttctaaactactttttcttaagtatctcagtggtagtgacaattgaaatgtgcaaagctagctagctactgattattaattactctgtcatctgagaaactttaaaaatattatgtttaaaaatagtatcatcaaaatccttttatcaagatcttgatttggtaaaaggtgaaaataataaaagggcacagcacaatagagacaggatgcatttaccctctcctgctccgcggtcacgctcccgccttgatcctcaagagagtggcaaatcttgtggctgcatatgcatgcttctgcttctctgcaggatgcagggtgcagacttgtccagcaggcacaggaggaaagctcagcaccaaaatacctttatgaatcagttatgttcaaatatgttaaacatctgaggggtggagagaaaaaaaggatgcccgaggaagaatgactaaacttaacatgaccacaaataatcctctccggtagttcagtaggtaactttattttgaacaaaattttatggcagatgagttgaaaggagaagaaattttctgaaattgtcatcagaagtcaaagagttttgcttttattttaacccaggccaagaaggcgcagtacctgcactgcttcatgaaacaaaaaacaaaacgtgttatcaacccaactaaatgcttaagattttaagactcacctagtccttccccaggtcagcctgacacctggcctggcaccactaatcatggcacaggttcagaaccaaggtcaagcattctgaactggggatagggaaaagggtggattttccctgaagctcgtgtagccagtttcggggtctctcaatttgaggggccccttccaagaccctgtacctaattttgtattcattatttttttcttaaagagaaggcttcaggacccacaaaatctgggtccactcctgggtgaaggtatctgtgaacctcctgaagacaagagtgtgagcgaggctgtgtggatatgtaaatgtgcttccatatttttctggaagggtctgtgtagtcttctcaaagccatctatgacttacaaaggttaaagaactcaggcctcggagaaattaatcaacctcttaattctggtcttataacaccacacttataaagtgatggtttaattgctagaggcaacaatttgtgactcaagtagaatagcttcctgaatgtatcacaggacacattgatcaccagagacatagatgagaatgttcttgatggttgctcatctcattggaatacacactctcatattattcactcgatcagtcattcattcattcattcctaaacacttactgagtacctgctctgtgactgcagcctgctaggttccaagatttcagagatgaattaggcagactcgctgcttttgaggaactcacatagttcctatcaatcaattcagctgaaggactctgcattctttctccaggttcccacatatatgtgagtgctgtccttgagatcttgaggctattttaaatagaaatggaagctcttcagcataaacctcactccaaaatattacgcaaaaagccaccctcataagagagctgtctcctggggatggggacaggtcttcgtgcaccactgagctccagctcttgcctccccctgccatgggaaggatggtcccattctgtccagctgtgtgcctccttacgaaggactcagagtgcagggagaccagcaggatatcggcccggatacctgaggagtgcagcagtaaataatgcttccactgtcattatggttgagagacttttccttgtggctaacagctgtgttaattctgctgttagccttctacagacagagcaagaattcttcccacacaatcacatataaataggagcctgtggaaactgggctgtagaagttgttttcatttccccattcctattctttgtgtcttgcattacccaatcctttgaattcaaatcctattgattctacatcaaaagtctgttgttccctctgccgtcatcctgatagaggtcctcattatctcccatttcatctgttgctacaacttaccactggattttctaccccattctcctgcctcccttcagtccaccccacacattcctgttcctgttaccttctgcaaagcaccattccagtgtctctcctgtgcatgctgagatgcagcttcccaaacagaagccaaagaggtaccaggaggttgctagagcgcttggaagggaagactgagcaaagtaccatggttgttcaaagatactttgtgcttctgtggatttcctgtcctgtcctgcaccgcctctgggctgcccctccgccctagcatttttccttccatctagcatttctcatctgctccttccacacccctccttccatctctcaaaatgttattcaggtttcaacaggggagtcccatgttattgggggaggcaccgattctgaagcaggtacacgaggtgaaaatatcatcaattgtgcttcgaaactagagccaccctgacaatagccaggtgctcctctctccgcttccctggacaccagctaagaagccggtgaacagaaaccactgagaaaagctgcacagtcaggtccccagcttctcagctctgcccaagcagggtttcccaacctgttctctatctggcatgaagagaaaatgatgatagtatttgtatggcacacaaggtactttgaggggactgagtgtggggttatgtggggtgggtcactcttggcgcagccctcctgtggcagcagaccagctgggaatctttgtcctagggatgtgtttgctgaatcatggcttccatggttgttggttggtttgtttgtttttgagacagggtctcactctgttgcccaggctggagtgcagcagcgcaatcttggctcactgtagccttcaccttccaggttccagcaattctcctgcctcagcctccagagtagctgggactaccggcacctgccaccacacccagctaatttttatatttttagtggagacggggtttcaccatgttggccaggctggtctcaaacctctgacctcaagtgatcagcccgccttggcctcccaaagtgctgggattacaggcgtgagccaccacacctggcccatggtgtttctttgtcattcttccattgctgagaagatatggttgcatctctctaagagttaaatatgtctgtggtatgactccactttacacagattctacccttcatgaattctgccttgattttctataaacacggcccgtctttctcatacagtttatgtgtagtctggagtcatgaacttggcctggcccttcaaggaaaggaactgactcattcatacctaccttggggccacctggcccatggtgggtgttcaaacgtgtctctgttgaaggagtacataaaaggcggcaccttctggaacccattgcttgattgatatcacaacagggctttctctgcatctaaaaataattttttcctctgtttctctctttataggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaa

SEQ ID NO: 470 - DNA, 21679 bp, Homo sapiens
ttaaacttttactatcgaaaggatttactttggtggagttgagggtgggagagaaatgaatctttatgttctcctgttagagaatagcttttttccttccagctttcacactggcacatgcttattacaattctaccttgggaacatgacagaatttttttcttatgcattcatgcaacataaacagataattctaggaagactgtgattaagtcacttgcattctgacctattattttcatctctccctgactctgggtgagccaaaggctattaagatgatgttctcctgctcactcactaggcagacctctactcgagaagtgatctgacaccgcagtagctgatgctcgtccagtgactaaagcagtcaggctgaaaacagattttatctcaacaacagtcctagtttcttctgtcctcaaacactgttatttattttcaagataaaatttagtaacaacattacgaagtagcttttattcccttgggtgaataagatgtgcacatttaataataaatttgcttactaaaggtccttttaggggaaaacaaccttaaaaatacagttctagtccttgggcagtgaacaaagaaaaaatgtgcttgagaaacacagtccaggttaaaggaaaactctcagatcggttaatgcagttgaatttttgcttgagaatgtgagcaacgtatcagcaaatacattcattcttgtgctactcttcattatttagcatagagctaccttaggtgtttctacacatgctctaaaccaagagtaagtttaacatgtcagcagtgaggagtagacattttctactatagcacactgggagatgtttactggtactctaggtagaaatgactccattgtccactaagtttgggaaataaataatatggcaacattgctactggagatacataatgtacagaagcctaactataaagagatttgattaacgagacttaagtcttagtccagaatttcccaaatttatgtgaacatgggacatcatttttcatagcacacacgtgaacaagccattattctttaaacaaggtattacaaactcaaccactctggagaactgatgagcgcctaactgaaattattagactaaattcttagtaaacaatgttttctgaaccttgttcagaaatataatcactgcaaattattttccaagtgttgttctaaaaaacaatataactggacactagtaagaaagtaaggtaaattattaatccactcgcattcaattctacaaggaatgaaaccatttttaaaagtggcttagaacaaacaatttactgagcacttactatgcacccaccaggtatattccttttataatgtaatcttcaaaatgagctgtcaaactattggcccattttgtgaatgaggaaaatgaaaattaagttatataatcatgagtggcagagctgggaaatgaactcaagtctgtgactctgaagacatgaaaaagttacacatttcagatgaatgcataaactatctttatgggtatgacatgaaaagtaactgtagaatgttaccttaattacatttcctaatgcatgatgtggacagacattagaaaagtttggactcagttggaaaaacaaatccagcagttaaaaaagtcctttacttgcaatccctacccctagctaacccaagagcatttaaaaaataacttaaaaagtagccatcaaagataccaatcaatttcttactggtgaaatatataagaacttccaggagtcacaagagttccaaacaattaatttataaaaataacaaaacatttgtctatgaaaaaaagatcaggattcactctcatcgacgtcctcatctggatggtgctcagcatcctccttttcctgctgctgtttcttccacagtttggccatggccaggagtttgaggttaggttggttggcagcatcttctggaaagatgtaatcaaagtattcttcccagcctgcatcagactacagaaataaaaaatgaaaagataagcaaacgtgggtgatatactcacatatcagagtgaagaatttttactggaaatccggatgattacctccattttacaaaataacatcaaagtctactacagaaagaacaagggctgggtctgaaagactgggagtgagtaagcagcaactgtagctcagtgagaactaaactggtagaaaaacattctaaaaatctaagcacagctcctctatagccaaccaagatgttcagtgtctccaactacattgtgcagtcttacacttaagaaaacgtttaacgatctttacataatattcacccagtagcaaaagccatacatctgtgcattattattccaactccctaccttcccatcctcacctcctatcagtcactgatttcacttcccaaatattgttctaacaggccctgtggccctgttctagttccagcttccatgtcttgctcagcttataaaaactgcttcctgatgggtcttctttctccaatctaagccccttgagtctgccaggatgagaggctagcaatctggtcacgtcattttatgcaaaacagccttcactgactcccaccaaactccttcttaccgcctacaagccttctctggataggctcctatctgaaagttcagttccatcttcctccacacttacttcctattaaatgctctaaaaatatcacacttcatgaagttcccagactcaaccatcaccaaaacacctttgccaaccccttcccgttctccacctctgactggaccatatgttctaccccgtgtttccataacagccagattgcaaccatctcctactccaggtggtctgcttccattctaagattgtacatatgccacttaaaagtccacatttcgacgtcagaagtgtttctactcatgtgacgtgagatgaacagtcccagggcagagttcttaccccatcatcagtctggacctttcttctcttcttgactttctctggcatgagtttgtctactctctccttatctgaagctgttccaaattcttcttcaaaacttcgccaagattccagcagcataagtctctcttccttttcttcacagtttcgcatggttttgttagcttcttcataaatttgtctgcatttagtcaaacttccttcttttcctgaagacaactcaaactgagcaaagctgatccatacctttaaaaaaagttattattgaaccaaattaaccatatcactcagaagataataatgtagtaataataaagcgaattcccagttaatgacatcggaaagtaatgtgtgcatcactaatgtttcacagatgaaaacaatgaatatatgcttcaatataaacactgaaaatatttgattctacattctacaattaaatgtctgacatagtcttaaactcttgaaaagagtttaacttggctgggtgcagtggctcacgcctgtaatcccagcacttcgggaggctgaggtgggcagatcacgaggtcaagagatcgagaccatcctggccaacaggtgaaaccctgtctctattaaaaatagaaaaattagcctgggcattatggtgcgcgtctctagtcccagctactctggaggctgaggcaggagaattgcttgaacctgggaggcggaggttgcagtgagccgagataacgccactgcactccagcctagagacacagcaagactccgtctcaaaaaaaaaaaaaatagtttaactttttttcaatcttgtgatacccaagctactcacatgcagcataaacaatgacctggtataaacttaacattccaaacattccaaagtcctctgagactcacgtttctcttgaaaagcaaggaagtcattaaaaaaaaaaaaaaaacaaaaacccaaacacttaaaatacagaaatatatcattttcttctggactgctgattcaagcaaaatgaaagatcatctacaaagcaaggataccttgacatgctgcgtccgttgaagcaaccgccggtaaaggtttcgtgttctttctgtttcttcctgctcaatttcaaaatcaatatatgatttccaaagcacctaaggaagaaaagtaaatgggtcagtcttgacatttacaaagcagcatgcccccatccaaagcacagctgaagtatcactctaacctacatctaggaacataggatttttactgaacaactaaagaacacatgtggataagataaataacattggtatctataagctggccaaaacttggctagaattccagattacagaaaaagggccttggattcagtcttagagattctctttggaagtttttcaaatgcttgacttatcaagagctgagaaacttgccaagcatctcccaggtactccatattctagccacacgcaattgagcgtccagagagaaaacaggcccaggttagccagtatgcatgttcttacctctactgtacattccttgttattatgagagttcagtgcaacaagcattcactgaacaggtgcgcactggctcggtgcagcctggcagggaataaggatgaataaaccgtggcatggacacctgaaagctggcagtctggtggaggagccgaggacaactgatgaactcagtgatacccaaagccctgccttaattaatgcaatcagggggccaaaccattaaatgcagggtcatgttagtgcatgagattaacaaaacggctgggtgagttctacgactcatgtgagattcaaatctttcctagctgtggtttggtgctaccttgtgggtcaagcttaactactgaaggcaggcgaggactttcaggacagtgacaacagaagttgcaaggacatcctggtttagagaatacagggatgtgcagttcctacctccatccccctcgttctccgggtgggccagcctgctggcttcttccttgcctggcctcttccccagcccctttaggctttcctgctgcagaaggggcgtcacccacccccatgatatcccagttcatcctgggcatcatcctggatgtctactgctctggtatctaatgagagggctacttcccctgtcccccacagccacctttccacgtacaagcctaatctgagtagaagagactaagttagttagatcatcgttatactctaaaatacacccacatttagatggtcatctaaagtaagactaaacacgtatctcaaacaaaattatatttgacttgagatgctcacctctggcatgtctaaacgtggctgactgatggctaattcatagattgcccgtgctctgtcaatatcaccaaggattgtctctaattcagcgaatttaatccatgaggtacaattttcaggtccaaattccaggaacttttcataaagcttccggcatctgtcaaattctcgaagctgtagctccaattctatgtaaactttaaataatttgttctttggacatttgcctatggaagttccctggaaaataaaataaccagaccactgtgatactgtagtggatttaatctgtgcagttattgcactgccctagaggctgttctctgctgaggaagaatcttgcaaagtcaacatggcctaccattctttccctctgtggtatcacaatgtttactggttcttgacaaaaggctgaaggaaactcctctaattcactcagcaagaggcagtgttccagaattgtttgggcaactaaataaaataagatttgaaagtttctcaggatctcctagggaatagggatgtcaaatgcataaaacctcctataaataaaaaggacaaggcatggtggctcatgcctgtaatcccagcattctgagaggccaacatgggaggatcatttccgcccaggaggcagaggttgcagtgagccaagatcgcgctactgcattccagcttggggaacagagcgagaccctgtctcaaaaaaaaaccaaacaaacaaaaaaaaaaaaaagaaaaaaaaagtggaacaattaaaagtgcatttaacacaccaaaaagtttgcacaggatcagattactaattccagtctgtggaaagatttagtaactggtagctatagaagtttccaatattgaaacagaatgttaatttgccccaggtaataagaataatttacgcattattagtcagtgtttttacagaggacgcatgttttctaacatgtcccaggctataaaggtataatacttctgtcactctttaaagtaggaactgtacaacttccaagcaccaagattttaatttctttctcatagaacttgatgagacatcttgatcctttctttacttaccaatgctcttctggctaatgacagattcttctgtcgtatttcaaactgtgcatacagtatccacattttggcaaatgtgaactagaaaacaaaagcacaaaaatatctagcttaaaagcctcatccaaattaaattgaattaaaattaatttaaattaaccaaagccattggtaattcgatttctctaaaacttcagagtaagaggaatgtactctgcttatttacaagcaaagaccacattcatttcacaaaagttagaaacccacataccatgatccagatactatattgtactgcatggcatggtaacctctcctgagaaccatgatccagatactgtactgtactgtatggcacggtagcctctgctcagaacagactttgttttgtaggcatgcttgtatatgggcagaatgtcctacctctattctgaaaagtaactcagtcaacacttctacagaaggaaacacgttttgtttctcgtgctgggaaacaaggcggaggtaacatctcaaccatctacacaaggggcacattcatctgtgcatgcacacactcactgttaccaacaaacccgcctgtgtgtcccccgcacacgttgtgtgctctctgcatggatgtctttctccttccactcagactattcacattacctagccttctctgaatttatattatttgtttgtcaatgcaggttgtcctccaacctagtctgtgagctgttttcagaggcaaggagcatatctcagtcttatttatgttgtccatggtgggacagggaagcattttatcaatcaatattatttcactgaattacttcacaagtaacagaagaggattctgacctgtttgaaatggaacactttagagcaaacatacctttttgtgaggaattagttccaaagaggcttgatacacctgtcttgtcctctcaggatcctgtattaggataagaaattttcacaaaatattgaagtctgctgctaacactcattttactagttactaattttactgatattggtaaaaatgtacacccccaaaacagcatgtttcacaagttgttacttgcaaaccctgatttatgatctaaagtatgaacggccatgaaacttcagtttaagaatcaccaacaagatagccaccaaacttctaagcccttctttgtagaaagccgttttgcctgatggcagaaagaaacaaagatgtttcatagtctcagatcaaacccagaaggttaatacaaatgatttctgaaaatgccacttgatttttgctaaaagcaaaaatgcataatctagccagaattactcctattaatgagcaaatccaggaaactatatttcactaaattaagggctggttcactgttctctttcaagctccaagtgatatcttgttgtgcctcaagtaaaaatcaaaccaaagttaaaaaagcccctcacgtgtggccacaacaagcacagagggtttaaaatgttgcagagcgaatatataactgtatggatgaacagaagcctataaaaatttaaaactaaatttccttctttcaagaattacaaacatccacaataggtgagctgtgaatacagaagacaggaaaccattatcagctgacacataattctgttttttcacctttgcctccaattcttcatagagtgcatagttgatccaaagataaatgtagcgcttccagtgcctcttctcctgaatgggtgggacattggcaatggccctttcatagacttctctcacggcttcagcttctgcgtcactttctaccaagcgcaagtaatcaaaccatgcatcataattgtgtggattcgcctagaaagacaaccagtttaataaataaaaaacaaaaccaagagctgcacttgccaggttaagcaagctgaaaaaaggcatcaggctgactttctatattttagcaccttttcttctaaatgttacatgttctttcattttaaaaacaccatccctgagactgcataaatagaaaagaaacaggaatacagaggatagattactggccaggtgtcccacagcaaggactccttcatctatagccatcactctcacgacagtcaataattagatgcctattcttgccaatgcatttgcttaaatatgtgactatgtatcattatgtctgtaacaacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaag

SEQ ID NO: 471 - DNA, 10785 bp, Homo sapiens
tccaagtggtcaccatttattgagcacctcaacttctctgatcttccatttcctcccagtggtgccttgatgcgggggggatgggggggcgggggggaagggggctgattatattttcataggagaaatgggacatgaaagaggctaagtcaccgacaggctcacacaaccctgcctccagagtccaaggtttggggaacgcatccaacccctcctcacccgtgacagagataccaggagagattcgagaggggatgggtgggggaggaccaattccacgacctgtgatattcgagagctttggagggagccctcggtgtgaccccttccgactgggtgtcttagggccatttaccacttcaggctacagccagtgagaccgtggtggagacgaaatgagggtgcagtgcgtgctacacacgaagcgctggaagggaggcatcgtgacggcggctgtgaatggcgtgtgtccatcaagtcacgctccgcttaccccactgcgggcaaacaggaaacatcaggaatctgatgctcaaggagggtcaggaccatgctgagcgcacccagaaccagcagaggccctgggcaggaggtccccaaccaatccccactcgctcaagaatcacacggtgttcagccccctcctccctgagacccaggagtccacgaccccaggccctccttcctcagccacagatgcctggggtccccagtcccacttcttctaggcttagtcctggccctctcctctctcagacctaggatggtcccccagccccctcctccctcagagcctgaagcccagttcgagacccttcttccctgagacctcgaagtctggggtcccagcttcttcagggtttcaggtgaatgggcccccgtctccttcccaaccccacatggaaggccaggtaaggtaacgggtttattcacagtgtcatttacaggcagcccccaccccgcggcatcagatcccggcgggaggcccgaagtcgctagaaggtggggacggccttggaggcggggggccgggccggatccccgggcgtccccggcgtcgcctcctcgtccagaccccggcggcccttgccgatggccaggcggggccggccgcggttcaggccgtccaggagcgcgcaggcctggcagagcgcgcggctggccagcgccccacagcgggagcaggcgccggggcgcgggggccgcgcggccggggccagcgccaggcgctcggccgagtgcacgaggtccagcaccgcggacggccgcgccgcctccaggcgcttgagcaggtcccgggcgtggccgcggaaggcctcgggcgcgtagacgcactcctcggagaagtagtcgaggcggcggaagtgcgcgtacagcaccacctccttctgcgaggcgaactgcagcgggcggcagcgcggcagggcgcccccctcgccgggagagcccaggcccccgccccgggccagccgccccgcgtcgccccgtaggaagttcatgagcacggtctccgccatgtcgtcggcgttgtgacctggtggggagagaagggagcgggtgaggtggggcgcggagggcgctgctggccagggagccccccggggaaccaagggtccaccaggacccagagagagactgggaggagagacccacggagacccagggcacagtggggccgccaggacccagagagagacggcgacggggagagcaagccatggagacagacccccaaacatggtgtgacagccaggatccagagacagggagggggagagagagccatggagacccctagggcactgtgggcaaccaggacgcagagagagacggggagggcaagagcgagccatggagaccctccgggaaccgtgaagcagccaggtgcaggctgcaggtggacacaacaaaaaatcaaagagaaacataagctcccctggcgcaacttgggcgtgccttcatgtaccacccgcctactgcatagcggaccttatgctagttgccctttcatatagggagtaaaagtgcattatgctgctaataaccttatcagcctcagttaaaaccgtaattcaaactgtacacaaaaatcagaaggcatttaaggcatttaaccgagattctcaggagagctggaggggtaggcaggctgctgtctcccccaccgcctagggaatccatggcctaattctgggaacctgttaatatgtttggttgtaggacaaaggggaattaaggttgcaagttgaattggggctgctaatcagctgactttacaatagggacagaatggtgcgttatccaggtgcgctcaaggtaatcacaaagacccttagaggggaggagggaggcagaaaagggagagatagggccatggagacctttgaacatagtgggcagccaggacccagagagagatggggaggggaagcctgagccatggagcccctctggcaccataggacagccaggacccagagaccgggagagggagatggggccatggagccccctgggcactgtggtgcagctaggtggtggctggaggtggacacagcaggaattgagaggggaacacacacaagctccctggggaacttggggatacctcatttgccacccgcctactgcatatggggggtgtgagggcagaggcaaggttagagtgatgcaaacggtgtaggactcaaactgccatccttggctttgaaaatggaggaagagccgggcacagtggctcatgcctgtaatcccagcactttgggaggctaaggtgggagaatcacctgaggccacgagtttgagaccagcctggccaacatggcaaaacccccatctctactaaaaatacaaaaattagcaggtcatggtggcaggcacctgtaaccccagctgaggcatgagaatctcttgaacctgggagggagaggttgcagtgagccgagatcactccactgcactccagcctgggctccacagcaagactctgtctcaaaagaaaaaaaagaaaagaaaatggaggaagggaccatcagccaggaatgtgggcagcctccggaagctggaaaaggcaaggaaatggacccccttgccccagagcctccaggagaaaggcagcactcttgacactttgattttagcccggtgagacttcccagacttctatctacagaactacaagataataaatctgtgttgtttaaagctgtgaaatttgaagtaatttgttacagcagccagagaaaacaactggttcttgacacagagcctctgacaacccagactgtagtttttttatggtttttttttttcattttgttttattgtgcgtgtgtgtgtgtgtgtgtgtgtgtgtttgagacagggtctcactttagtgcccaggctggaggacagtggcacgatctcagctcactgcaacctctgtctccagggcttaagtgatccccctgcctcagcctccagagtagctgggaccacaggtgtgtgccaccatgcccagctaatttttgtatttctatacagacgcagtttctccatgttggccaggctggtcttgaactcctctgagctcaagtgatccacctgcctcggcctcccaaagcggctgggattactagcatgtgtcaccacccctgtaatcactgcagtgtttttgtgttatctttgtttagaagtaacagtgagaaatatttacacactggtcaccatgaaattgaagctaaacttgttctgtgtcttgtcaagttatacttgagtctatatcagtggttctcaatctgggatgagtctgccctccttccctcccccagagacatttggcaatggctggagacatttctgtgtgtcaggttgggggtggggcactactattaaatagcatctagtgggtagaggccagggatactgctaaaatcctataacacagaggacagctccctaaaaacaaactatctggccccaaatatcaatagggctgaagttgagaggccctggtctatatggtaaaaaacctccaagaacttggctctaattgtgtttgtagtaatggttacctcccaaagacctgccaagccctgtgaccttgagattgggcatgtttgctactgcaaacgacatctcgttgaatgtttattgacttaaagttgtaaaccacattaattaggggagactggatttgctccacaccttgtcattacaaacccacttaagagctcccagttttgtaataattattacaacaattattatactacgcctttgaaaatggagtgtataaacaaagggtagaaatcaccttgcaagtcagggatttttctggaaggcttcattacttttggaagtacaattaataagtgattctatcaaattaactttaaaatccgaggcagcctctcattctttttttttctcccccagctggaatcttgctctgtcacccaggctggagtgcagtggcgtgatctcgactcactgcaacctccgcctcccgggttcaagcaattctcctgcctcagcctcccgtgtagctgggattacagccgcccaccaccacactcagctaatttttgtattcttagtagagacggggtttcaccatgttggccaggctggcctcgaacgtttgaccttgtgattccgcctgcctcagcctcccaaagtgctgggattacaggtgtgagccactgtgcccggccgaagcctttcattctttccatacactgtctgctcttgtatggtaaggattattcttcccattttcaatcacagagatctagggatttctccaaagttactcagtaaggaaagggccacatcagtgaatgaagctcagtaagccttccccagagccagtggccctacctagcatggtggcacatgacagcctcagaactacttttgccttcatatgctttcagtgtgctgattctctccaaccatcatctctcacctccatcaccgcagctggcttcccactgactggtctcctcggctttgtccctgtccctccaacccaggttcctcgccatggcctgggtgagcttttcaaagtgaaactctcttcatgtcacttttactggttccgccacagcctacagggtaaggcctgacctcttccacctctccagcctcccctgcccttgctttctgggttccagccacactggacttcttggggcagcccaaattggcttttcacaggccaataacctctccctaattcttacccgctttacctcttcactgtgagccttcagatttcaaaaccgttccttgaccccactccctccacgtcatagggttctctgtgtgtacacatagtccataacatgtccatacatggtcaataacatgtataatgtttataattttgtacctgataaccatgcaaaggtaggaacttgtgcgtaactgtattctcagccctagcctgacaatgatgatgataatagcatgtataaaatgtgtaatctatattatatcatacgggttatgtaacataactataatatagataacgttatacttctactgactcatctaattgtcataacaagtttatgagctgggtaccattcatagtcctgttttagggatggggtgaaacagaagtacagagtggttaagaactttggtatggccacagttgggatccggcatatagcagaaacttagcatctgtttgttgaaggaatggatgaaaaagacagaataaaaaagttatcttccagcactttgggaggccgaggtgggtggatcacgaggtcaggagatcgagatcatcctggctaacatggtgaaaccccgtctctactaaaaatacaaaaaattagctgggcgtggtggcaggcacctgtagccccggctactcgggaggctgagccaggagaatggcgtgaatccgggaggcagaggttgcagtaagccgagatcgcaccactgcactccagcctgggagacagagcgagactctgtctcaaaaaaaaaaaaaaaaaaaaagttatcaaagaggagaggccaaccaagaaaaggaattaagagatggagatgctttttagagaaagagctggattctgaaaggtggaccataagagatcaagcatgttagaaacatttaaaaataagtaaaggaccagagatctccagagattttcacctcccacccctttggcaatctgtggagaccaagacggtggccaagacccaaaaacctttgtgatcactgcctggcccctctgtctccccagcgtcttgaacctttaaagggccccagccccaaactgcagcatgcgcccttccgcacctccgtacagggatcctcccattaagccaccagggtctcctcgccgccttctggagcatgcgcctgaatcccctttcaggtcccgcctcctcgcctgtgcattcgccccactgcctcggagagtgccgctctgcggcccgtactacgctcacctgtcacgatgtgcgtggctcccacgcggcgcgccccttcctccagcgcccggcgccgcagcactccacagaaggtgcagcaggagcggctgcggccggagccggctgtgctgcgggccacggcgtccatcgtccagcccccaaagaggtcttcgtaggccacgaccgtgagcggcagctcccagcgcgccgcctggcgccgcacggccgccaacgccgcgtcccggtagccaccgatgccctcatcgacggccacgagctgcagtgagatgcccaggcgcggcgccagcgcgcgcagcacgtgcgccagcaccgtggagtccttgccgcccgaggcgcccacggccaccaccgcgccgggcggcagcaggcggccggcgagcaccgtgtgcagcacctcggcctcgaaggcggcgcagaagcaggcaccgcacagcgcttggcccgagagcggacggcggagggcggcgcgtgcagcatggcaggaggcgcacggcggggcgggcattgcgggaggggtcggcttctcctagacagggagagagaggaggtgggttacatatggattccggattgcagggtccctgccatcggggagattgtctggattgcacctctgcccggaatagaccagggagacgtgtgcgcgagtggagtagcttcttctagcgctggggataggatggttataaataggtccggtgtaaggaagccactgccttagggaaggcttcttggattgcacccattatgcaagaagaagagaagtagcttaagaagctggcttcatgggtaaagagagggagcgacaagcaggttatacccaggattaggttgtgtcctctccagagggatgggggtgtatattaaggcccatttgtcacaacctccagggaggccacccttgttacagtcctgatcaggacaaggtaggtatcattggcctgggccaccagggctgttaaaagcccttgggaggtgaggggtttttgactctaagggcagagggaggccaggggactgaagctctgtgcagcgggaggtggaaaacaggaaaggccaactgattgcactttgtagggtgggatacggtctccaggaatgggttctgattgcatcctatgaaaggcagggtgatcaccttctccagggaacacaggcagcctggatcacacctctcaggagaccagctggggttgcacacattttgagggtgagaaaatgggtgggcctccaagattgaactcaaccctgctctggtatcagaatgccccacaagcttctgtgctctcaccaagacatggatcggcccatctttgaccttcatctgttatctttcctacttcattcttccccacccagcctagactccaaccctccagtcaaatcctggtcctgcctgcctggtgaacccataaaaactccccaggctcagttctcctccccaagccaccatcacctccagcctggactactgtagtcacctccttgccattcagagcaggtcacgctgcttctaggatttaccacaatgtgtggaattattttatgtgactatatatttaccatctctaacttctatgagggcagagaccagtaccactcagatgtctaataggcatctcaaaacccaaattcctgattcttctaacccagcgtgcttctcctggagtacagggcagctccatccttctagctgctcaggccaggagctttggggtccaggaccctggactgctctttctctcactgcacttgtcatgctcccagtgggtggcaccaaactgcaatgccaagtccggaccttttcaaactccaggtacctaaatgaaatttagcaaatcctgtttgaatgtagtttcaaaacagccaaacacttaggaccgtctccacggcagcaccctagtctggtctgtctctctcctggacggctgcatggggctccccacaggtctcctgctcccgccttgcctcctctacaaacactccttcacataacagccagtgggatcatgccctgaatcttctcagcatcctcccctggatcccatctcactttagtataataactgctaatggccgatgaggccctacatgtgtggctccttgtttctccaacctcctctccttcagccttgatgtcgtttactctgacacctgaggaatactcctgctccagatgtttgcactggctctcccctctgccctgagtactcttcctgccactgagcccaagaagcagcccttaggactcatctgcagtgaccgtcgggaacatctgtcacaggtgagcagcaactcttggaatctttcttcccccgacttttgactcactccttctgtgctcctggatttcctgctcaattctcttttggggacgcctcttcatgtcctcaggtcctgcctagcacccatctctttccattttttaaagatttttaatttaatttaatttaattttttgagatggagtctggctctgttacccaggtggaatgcagtggcacaatctcggctcactgtaacctctgcctcccagggtcaagcgtttctcctgccttagccacccgagtaactgggactacaggcgtgtaccaccatgcctggctaatttttttttttttttttgtatttttagtagagatgcggtttcaccatgttggccaggctggtcttgaactcctgacctcaagtgatccgcccgcctcggcctcccaaagtgctgggattacaggcgtaagccactgtgcccagcttctttccattcttatgagcgcctctgaatcatgatattcagatgtccctcctggctggtcctccacatggctggggcaccttaaagatgttcagaccctaagcgcccagacaacctatttcttcctcgaaaggcagaaacctgttcttgcccatctgttccctctcttctgagagcagccaccacctttcatccagcccatctgcaggacaggacgtaacgtcaccctggactcatctctcctcaccccctaaatctacagtcacccagtcctggggggtccacgtcctgaggaagggagacgctcgcaggggacaaggctgcacaagttagcagagcctcataggccatgatgtggaattttaggtttattcaggaggagatgggagccttgggaggtttttgaacagtaaagtggtatgatctggcatgttttaaaaggattcctagactggtcaacatagcgagaccccatctctaaaaaaataaataaataaattagctgcacctggtggcacaggcctgtagtaccagctactcaggaagccaaggcaggaggatcacttgagcccaggaggtcaaggctgcagtgagccatgatcgcaccagtgcactccagcgtgggtgatagagtgagaccttgtctcaaataaaaaaagtgggattcgtttggctgctgtgtggggaggactgttggttgtcagggacaaggacagaaggctggaggtcagcacactagacaggagtgctggcagtagaggtgggaagaagtgaaattttggatctattttgaaggtggagcccacaggacttgtataagactgattggagtggggactggggcaacgacgagagaaagtgatgaagggtaactttgaggttctggcctgagcattggagggacggtggggccattttgtgaggtgagaagaccaggaattccatttggccacgtcaggtttgacatgcatgttaagcgtcttccctcaaagactttatggaccctcgtcactgagtcgagcgcctccaccagggccctcagagctgccctgatcctgactagctgtcactggtgacaggtctgtctctctgcttcaaggcagggacagggttggtctggtgccctcgctcccgccgccctgcgcagagtcggtgctcagtaagtatctgtaggatgagggaataataagtgctcccagaagagaggccgcggaccccagggatgcctctggattgcagccttgtcaaaaggacagataatgtgtggcatgggggcggggacaggcagatagtaacataggggcgggggcaagcagatggtcttatcctgtcttggggaagggagtggcccggtaagagacaggccggaccgcagcgttcaaagtgggaatcctggctacaaggcctcagggacacgggcgctgggaaatcacagaggccttacgctcgaagagaccctcaaccctcccacggcaccgcaacaaagagccggagtccacatgccgacccaccgcaggaggaaatactcacccgggcagaactcagtgctgggatgcccacactgcccaccacgc

SEQ ID NO: 472 - DNA, 11217 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 473 - DNA, 116618 bp, Homo sapiens
gaactctaatggttaccttgttttctacttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccaggtgaggaacagtgttttgctgttgtggtttggtattgaagatggaaaacaggaagagagaaaaaaggggtaagagacagaacaataacacttcgatctatggagacttaggtatctggagacttaatgtggagtgttgctggagaggcatcagaaggctttctcccttagggaattccatgtggtagggagagatgtttcaatttattcatgtgctctttggcccacatctggagtcaggggactaggtctctgccacactcatctttttagaggctgtcatctggaaaggggttggaaacctggatctggtcgtctatcttgggggcttacatctggaagtagttttgaggatccaggagatgctgttcaccctggggactgtcctgaagcttttgcatttagaatgaagagacatttaggatgcagcaagggagttccttttcaatttcctagggcaggctgaaactttgaaatggagtgttggcagggaataggaaggaggggacatttatttctcctgaaatagtctttaaaggaagtttaatattttaaataaaaaatattcttttttaaagaggaatagttgacatgaatgaatcccatatgcttgtgttaaacctttctgcctaacaatgtgaaactctagctgccaaaaatcttgaggttgagagaaggcaagggatattaactttgtaattttctttttgttcactgctgaattgtcatcagcacaggaagaacctagaagcagctaaggcgttatagctcattaattttgaatttacagttccaaaaaataaatctgtattttcttactttcaccctacctcatttccttttacgtttaagaaattgagtttgtaatctgtagttgtatctttataagaaatagggtaacttttacaaagtcccccttcattagtaattgcagaaggtatacttgtagttacaagacaacaaggacttggaattttttaataggaaagaggagtttctttgcaaaagaatttgggacttgactgagtcatgaacctattctctccctctatttgaatttatttccattaaagtagtactaaccattggttaccgagaattaaatattacaaaaagcttatagcaagaagctatcttctatcccacttcccctcatcctcaatcccgatctccatatataaccacttttaactcatctattttattgatttgtctatttttggcatcatttttcttcatcttctagatacagttatattaatgtatctattgtgtattgatccacatctggaatcaggggattaggtctacaggtatcttttacatgtaatgttactacacctttatttcttccttcatcaactgcagtctcttttgactccccacttcgtaagatgacagtgtcagcctttgtaatccaccttcagctgtcctttcctctcccccctcacaaactctgaagtttttacttttataacacttacagcttttatatcctattcagttataaccataattaaatatttgttttgtgtcttgggtaactctaaacttctaaaaatatatattactaataaataaatattcacatggagtcaattaatctatgattatattttctttcttatatgccatttttgttcccttggagtttctaataacctttcctttgttcttgtgccttagttttatggtagcctcattttatttcaaactgtataatttttttctgtcaaatgtacttttccttgagagacttccctctaagaccctccatcctctgccccactctatgttgactgctatctaggtttgctagatactgtcagccaaggacattccctttgttgctctcttaaattggacccactgtttcctgtatcctgtattttcctttcttggcttgctctcttagtttttcaggagtctcgagaaatcatcctagtctgggtatgtggtagttaaattgtttgatcccttgcatatctgaaaatttctgtattcttgtctcacacttggttaatagttgtttagtaaaaagttacacattccaagatatatttccataggaaaaagccccaagagtctgattatcattacattgtcttcttcttgtggctccctttgttacttgccctctcattcttctatttaggggtaacctacgtgttgacttctgtttgttcactcttagttccttcaccagggagctgtctcagcccagtgcttacttttaaagaagaaattacaccactaagaattcaactgatttgcaactaggctgcttatagtctattctgtctttaaagtactttaaaagtcagattcaggccaatggtattatgtttagctgttcatgaactagtagtttttcttatatagggtcttggagaaattgtggaattttggaaaaaaaaacacaattttccctatgtaatgggagttctagaagcatgctagataaaatgtgctagaaaccctcaaagaatggttgtagattatcatagagttcagatatacagctccatccgtctcacagttggtagtaaagggcagatggcccggtgcagtggctcacacctgtaatcccagcagtatgggaggccaaggtgggcagattgattgggctcagtagtttgaaactggcctgggcaacatagtgagacctcatctctacaaaaaaataaaaattagccaggcacagtggcacgtgcctctggtcccagaggattgcctgagcccggaatgtgggaggttgcagtgagctgagattgcaccactgcactccagcctgggctgcagagtgattctgtctcaaaaaaaaaaaaaaaaaaggaaaggcagatgaaggtttcaaagaaagagacagcttagagaattgaaaaggagagtttagaagtgctggcacaacttaactggttcagcagttaccagctatatacaaggcacttagtttctttgggcctcaatttctgccttcatttatttaatccacaaataagcaatgaggaccatctgtgtctcaggcactcagaactggtgattcagtgatgagcaaaacaggtggaaatctctgccctcatagagtttatgttttagtcaggaatgatgtaagaaacaaataagcaaaatagggcgtgaggcggtgattagtgttaaggggaaaaataaagcagagagaaggggcagggtgtattgtgacattcagctgacctgactgatgccacagagtgtctcttgtgggctttataacttggtgatgtgtatgtcaaaattcagtgattataattcttattctaacagttttctctaaaattcccgtgtacttttaaagttaatttgaactctttcttatgtggctatagtcataccgtttatcagtaatgtttaaagctacccatctacctatgacttttgtttcattttgttttatgtctacagtgtttatcttttgaagtagccttttatcatcatatgaagtccagtttgccccaatatactgattttttggtcatatttcccacagaatgcaaagtattaacatagtcttgatttgtttttaagttcctaaaacaaaaacactacttttaaatttctgtactcataaaatgctaatagaataacaacatcaaccattcactgggagccaagcatagtatcaggagctcatcattttctacaacttgcaaggaagttattaccctcatactgttaataaaatttatggttcaggaagaggttaaatcatttgtcaaaggtcactcaaccagtaaatataaaatgaggtctccttggaggttgctttcggctctattgtattattattctatatatttagtgtgaaatttatcagggtatggtgttcaatttatagttcttaaaaactgagttgcctaaagacggctgctctgaacactacatgcattgtcctctcctcccatttgtttgcatatttttttttcttttaagagacaggtcctgctctgtcacccaagctggagtgtactggtgtgatcatagctcactgcaggctcgaactcctgtgctcaagtgatcctcctacttcagcttcccaagtagttggggctacaggcgtgtgccactacccctggctaattaaaaaaattttttttttttgtttggagaccgggtctcactttgtcacccaggctggtcttgaactcctggcttcaagcaatcctcccacctcagcctcccaaagtgctgggattacatgtgtaagccaccccacctagcccatagtgattcttgtattattattattattattgttattattattatttttgagacagagtcttgctctgtcacccaggctggagtgcagtggcgtgatctcggctcactgcaacctccgcctcccaggttcaagtgattttccttcctcagcctcccgagtggctgggattacaggcacctgccaccatgcctggctaattttttttgtatttttagtagagacggggtttcgccatgttagccaggctggtcttgaactcctgacctcagatgatctgcccacttggcctcccaaagtgctgggattacaggcatgagccaccacgcccggcccatagtgattcttttaacaaatatttaccattcattttcttgcatctatgctgttcccaaggatatagatgtgtacaaagtgtggtccctgccttcatgtttggtgattaaattaaatgtttatatatttaaagctccatggctggcatgtagaagctttaaatacagtttagctattatgattagtgttaccattatgatatgactagcaacaatgataaaatgagggggtaggggttctttagtaaagaacctactttagatcctacttccatttttctttgctaatttaactagtgaagctctggaaaatttcagtcacttctaatgacaatgaacaaaatgggttaatgtcctataatttatggtgaatgcatttggactgtggctcttgaaatatggggatgtcaacaattttcagagaagcactttatgaattttaagggcaaagatcttgtctcatccctattgctttttacttactaactcatataatgtcaacatgagtgaaatggaagtaattttcaaagtcctgcctaaccaaacacacgtaggaacaaaggttcctcacaggtaaaacaaatagccatcatctctaattgtgtgcagcattgttgacatgtatcataaagtccaacggcagtgtggcaaagttccccttaagctgctcacatgtgcagctgaccaggacaaagatatggtctgccatagctttttatttggccataaacaattgacagtaaataagaccaactctaaccagatttgagtagtttataaacttactaattgtgtccttaatctctccttttcatacttttgctgtccttaatgaccctttaacccaatcaacttcattcattcatacattaaacaactagttatgtgtgtctgcagtggagtaggcactctcctaggtggcagcagtacaaaaaggaacaaaatcattcatatgtccctaataggtttagtggggaaagttaatgaaacatacaaataagtgtattattacaattgtgaaatattacactcgtgatgtaggagaattgtgaaaagtgctgtaaaggagaattgtgttgtactatgagtctctagtcagacaagtcttgtgctatgagagtctctagtcagagaagtcagagaaggtgattgtgaaaacgtgcaactgagttaagatctaaagcaagcttgtctaacccgtggcccgcgggccacatgcggcccaggacggctttgaatgtggcccaactcaaattcataaatgtttctaaaatattatgagatgtttttgttatttatttatttatttttaagctcatcagctatcattagtattagtgtatttcatgtgtggcccaagataattcttcttccaatgtggcccagggaagccaaagaattggacatccctgataaagaaaaaattatgcagaggaagaggaaaggaatgaccatgagcagagacttcccgtaactcttcctccttgggcattctggtctcactttctaacccaagcagaacagagaagatccatgtcatttatactgtttgtcagcatcaagcctttctcttctcctgttccatccactgaaaatctcttctttctccatcaattaggtaatgcctcctatttcctaagcctggctatcaaaacagggattcattatcctgttttgttgtgtcctgtcctggtacaagggcacatagtaccttctctccaggaaccgttcatgtctcctttgcctctgctttcatgccaaggcatatattaaggtctcttgaacccctgctggaaatgcagcttctctctctgctggcaggtgtctagaaaagacacagccctcttctttccttcactagtgatgtggaaaaactgatatactctatctgtagacctgccttgactcatctgaaaagtgggcctcgtcattcttagctcctaaagttgccatcactgttatctacctaatataggatgccttatccatattgtttacatagaaaattttagccgaaccttcaaacttccaaacacttaagattttacattttaattgaatgtcattttaattgaatgttaaaattttacattttaattgaattctaataatttgaaactcttgtccttccttcttattctttccttatgaagcttttgatggcatattaaaaggcaatggcttgataatctttttatgttaatgccagtagagaatccttcttatatttcttgacattgagcttaactttgggatttaaggggccagcagtaagaggttgtgggatctccatgaaatatctagagatgagataacatgctggccatggaaacttcccctcaatttctagtgaaattataattgttttgagaaatatgactttgttaggaagttactgcaaaattaaatagtagctttgaaattggcagttattcatataaataaattccttcaggaagagctggattcagaagcagtttggcagttgtattaaacagcggttttaaggatgccacagatttctttaaaaaaaggcattgataagaattagcagattgaaccataaattgaacctccttccatacgttggccatacatatgctaattcaaaaatgtaaaatcgttattattccctcattaatttgattcgattacctttacaaaatagtttacagaacctgacatgtatattatatactatttgattataataaatgtgaatatttactcttcttaaggaagttaaagattcactcttcttaaggaagttaagtagttcaaacatatttatacatcttataggcaaataatcaaatagtttattccaaaatggtataaccatgatttagtttaggaagacagtcttccagataaagatggacatttgagaatttttttaatacttaaaaaggttttatctggccaggtgcagtggctcacgcctgtaatccaagcactttgggaggctgaggtggtggggatcacctgaggtcagaagtttgagaccagccttaccaacatggtgaaaccccatctctactaaaaatacaaaattagctgggtgtggtgatgcataactgtaatcccagctacttgggaggctgaggcaagagaatcacttgaacctgggaggtggaggttgcagtgagccgagatcatgccattgcacaccagcctgggtaataagagcaaaactctgtctcaaataaaaggccagggagtgggggagtttatctaagttagtcaaaaccaagtaattaaaatatataataagtagcatagagttttctagtgataattaatagctacaagcatggaataattaaatattaagagaggctgtctggtccaagttctaggcctacatatgatatgcactacattgaactgaatataggggctagtgagaatgagcaggctagaataaagaaagcatgcagctcattagaaggaaataaataaagctgggcaaattagaacagattaagctcaaaagatacttgattttgaaaataaaaactgatgtggagccataatgactattccatagtttgagtctttacagagatgatctaagcaggcatcattcaactaatatttattgagcaactattatattccagatattgttctttgaatgctagatgattcacacacagaccctgtcattggaaagtttcctatttaatagtagaggtaaaatatacatgtgaatcatagaatcaacataaatgcccatcagtgatatgctggataaagaaaatgtggtacatatataccatggaatactatgcagtcataaaaaatgagattatgggccaggcacagtggctcatgcctgtaatcccagcactttgggagtccaaggtgggtggatcacgaggtcagaagttcaagaccagcctggccaagatggtgaaaccccgtctctattaaaaatacaaaaaattagttgggcacagtggcaggcgcatgtaatcccagctactcgggaggctgaggcgggagaatcgcttgaactcagagggtggaggttgtagtgagctgagatcgtgccactgcactccagcctgggtgacaaagtgagactccatctcaaaaaaaataaatagaaaaataaaaatgagattatgtcctttccagggacatggatggagctgaaggccattattcttagcaaactaatgcaggaatggaaaaccaaataccacatgttgtcacttataagtggcagctaaatgataagaacgcatggacacatagaggggaataacacacactggggcctatcagagagtggaagctgggaggagagagaggagcaggaaaaatacctaatggctactaggtttggtacctgggtgacgaaatagtctgtgcaacaaacccccatgacacaagtttacctatgtaacaaacctgaacatgtatgtacccctgaacttaaaagtgaaaaaaataaaaaatatatatacacaagtcattataatataaataataataattgataatagaaagtacaccgtgctatgcaaatgcaaaaggaggatgccttcatggggaagatggtaaatctcaaggggaagcattaagcacgaaaatctgttataattattggagaaccaagatattgttagtatttaatgaaaacagaatcctgaaacacatcattactgcagaaacaataaagaatttttatccagcaaaattaacagtccttctgtggccatttttctcattccatgaaaatgtcattcagaagtggctgtgacctgggacctcaaagccgtgatcactctgcatgtacctgtgctccagacccagctctgcggctgctctgcatgcacttgcacttctgacagtggcatctctgtggcccaaacatgcccatgtgctggacctaccaccaaggggcatccccttggccacaactacccctgatagaaggaaaagagatcagcagcactgcagcaccttttactgccaaggaccccaatatatgcaaatcaatcaatgtgatataacacattaacaaaacgaaagaaaaaaacccagatcatcacaatagatgcagagaaagcatttgacaaagttcagcatccattcatgattaaagctctcaacaaaataggtatagaagcaatttaccttaacacaatataggctatatatgagactcccacaactaacatcatcatcagtggggaaaagctgcaagctttttctgtaatatctggtacaaggaaagaatacttactttctctacttttcaacatagtactggaagtcctagtcaacaattaaataaggaaaaagaaaggcaaccaaatcagaaaataaataatgttatctctgtttgcaaatgacatgatcatgtacatagaaaagtctaaagactcaataaaaaaccgttagaactaataaatgaattcagtcaagttgcaggttataaaatcaacatactaaaaatcaatcatatttctatatacaaggaataaagtatctgaaaagggaattaaaaaatcaatccatttacaatagcaataaaaataataaagtactcacaaacaaccaaacaggtcaaagatttatacatgaaaaattataagacattaataaaggaagttgaaaaagatacatgtaaatggaaagacatcccttcatagataggaagaattaatattattaaaatgtccatattactggaagtgatctacatattcaatgcaattcctatcaaaatcctaatggtattcttcacaaaaatagaaaaaacaattttaaaatgcatatggaactacaaagcaacctgaatagccaaaacaatattgagcaaagacatgaaagctagaggcattatacctcctgatttcaaaatatattacaaagccacagtaatcaaaacagtgtgtcttaggcataaaaacagacacatagaccaatgggacagaatagagagcccagaaataaatccacgtatgtatgatcaactaatgtttgaaagggtgcgaagagcacacattggggaaaggatagtgtcttcaataaatgttgggaaaattagatatccatatggaaaataattaaattggacccttatctcatatggtatacaaaaatcaacttaaaatggattaaagactttaatgtaacacttgaaactgtgaaactactaaaaggaaacatagggaaaaacttcttgacattggtctggacaatgattttttggatatggtgccaaaaacaaaagcaacaatagcaaaaatggacaaatggataatttaaaactaaaaacctgcacagcaaaggaaacaatcatcagaataaaaaggcattctacagaatgggagaaaatatttgcaaagcatatatatgatgtggttaaaatacaaaatatataaggaactcgtgcaactcaatagcaagaaacaaacaaacaaataacctgatttaaaaatgggtaaaggggccaataggaggatcatttgagaccaggagttcaagaccaacctccacaacattgcgagacttgtctcaaaaaaaaaaaaaaaaaaaaaaggtaaaggacctgaatagccatttttcaaaagaagacatgtaaatagccaataggtatatgaaaaggtactcaacttcactaatcatcaatgaaacacaaagcaaaacaaaagtgaagtattattttacacatgttagaatggctgttatcagaaagacaaaaagtaagtattcacaaggatgtggagaaaaggaaatgttcgtacattgttggtaggaatgtaagttggtacagtcattatggaaagagtatgaagattcctcaaaaaattaatagtagtatgatccagcaatcctactctgggtatatatccaaagcaaatgaaatcagtatgttgaagaggtatccgcactcacatgttcattgcagcgttattcacaatagccaagatatgggaacaaccaaaatgtccatcaatggacaaatgaataaagaaaatgtttgtgtatgtgtgtgtgtgtatatatatatgtatgtatgcacatatgtcatgtgatgcctaacagcatttcagttaacagtgaaccacatatatgacagtggtcccataagattatacggtattcttactgtaccttttctatgtttagatactttttgatacacaaatacttaccattatgctacaattgcctttagtattcagtacagtaacatgctgtattgcataggtttttagcctaagagcaatagactataccacatagcatagtaggcttatagcaggtgcatagtaggcttataccatctaggttagtgtaagtactatgatgttcacacaatgacaaaattgcctaacgatgcatttcttagaatgtgtccccatagtaaagtgacacatgactgtatatgcattggaatattacttagatttagaaaagaaaattctatcatttgcagcaacatggatgagcctggcagacattatactaagtgaaataaaccagatgcagaaagacaaatactacatgatttcatttatacatggaatataaaaatgtcagactcagaatcagagagtagaatggtggctacaagggtctagggagagggagataaggggagatgtaggtcaaagggcacaaagtttcagttatgtaagataaataagttttggagagctaatgcacaatgatgtgactatagttaatattgtatagtatacttgaaatttgctcaaggggtagatctgaagtgttctgatcatacatacgcacacagagaagaagttacaagaaacagtttgagataaatgggtggagaaagctgttaaataataggatgagattttcttttgcaggccatctattttattcagaggttgaaaacacatgcctccaggcaggtaacatatgagaaaaagggactaggaaggaactgtggctaactggtagctcatacatgcatagtcagtagtgacagtccagccagtccccagcactggtggatttttgtcacagcaggattgtgtatttaaaggttctgtggaaagaaatactattttttaaaatactgtgtctattagtcataccagtttctgagctaagagtttaggcttaattcagcaaatgggatgcattgttctctatgtactaaagtatgcaggaatatttctttaaacttttccagtctaaatgtttcttaaatttttgcccaaacatctgggaagatctcttagtttctatcagatatctccctttttgcaatttgtaaatcaaagcgattttctaaattcagtcaagtaggagaggaaaatagaattgctgttggtgactgtggctcctaactatggttagtgagttctgagggtgaaacaaagctgaccctggagttgttccttggcacttccagcaaggctgcttcaggttccttgcctgtggttgaccctgcacatggagatcctgccaatcccactcatatttacaggtatcactcctgcaggtaagcctaacatacatgtctcttcaccgtgagccaggtaatgaatatatatgtgtaatttaatcatggtttataacctatgcctaataaaagagtgcttgtgaatttagaaatgtttgaaaaaatgagttagaaattaagaaaataagcaggttttaaatttgaaaactagtaaagtgtcaatatgtatgtatgtgtgtatgtgtgtgtgtatcaggtgtttactgcatttctagcaccaggtatggctaacattttaccccacagtattttcctgggcctaaaagattaccatttaataatatctgctatttgcctggcactttattaaactgtctctaatccttaagacaaccctaagaagtaaatgctagtatccccatttttataaagaaatagaggcttaggaatttgagtgacttgcccaagatcacatattcagtacattgcatagcaaacagcctgtgctttgcctactgcacaatacagactcaagaatgtgcacatgataggacaaggatatttaaaatgagaatttcatgtattgtattccatttcattttgtgagcatgtgtatgtgtgtgagcatatgtgtctgtatacatatatatatatatttgtatcatgtgcatatgtatgatcattctgagcaatagtaaattccttttaaagatgcgcagtgtattactgaagacagtggagggtaggagttaggaatataggccgtagaatgaacctaggtcatttcaccataaatcatagcctggacttcagatcccttttctgtaagatcagggttattgcgaggtccacattagacaaaattcagcttggcacagtgtttcatatatttggcacttaatttaaatttaatttaagtattggtcagtattgtcattaataatctgtatgttttctccttaaatttcttgtcttctctcttacttattaaaaatatcactatacattgaacctagattctataatccaaaggcatcaatggacattgagatgcttgcctcatatccaagatgtaagagaaagtgcacatgcctattttaaggcaggccacagataggctataactttcaggtatgagtgggtcaatacaatcaaacaaatcagataaaatttagtaagagcatagacagacagtatttggagcaagtatacaaagacatagaaaagactatctacagggaggttggaaacatttaggatatactgggtagagaaattataggttcatcttttgggcagctgtttagatacaatctagtaggattgaataaagggaatttaagtcacaatacatccattctttacatcttttgctatgtaatgctacaggcaggcagtaatgagtactaggttcattgcaatgagatagaactgaaaaaggtacatctaaaaggatttttaagactaaaacttggtggcagattgaatttaggtggagggagagaaagatgttctaggtagctccaatgtttggccgccataggtttatgagaagtgggagaagcagatctagtttgtccagggggcattgtccagttttatactttgaatttagagtgatccactggagttatcttagaagccgaaactaacaagatccacttttttttttttttttttttttttacagggataactgtaaattcctacatttaggttaagaaatgaattcaattgcacaagtccaggatgtgggatatctgcttgacagttagcttaggggtttttattggccacagacaaaactaattatgcaccaacaatgtgccttgttgctgaaagagtacatgccatgttaggctgcataatagaagtgttgtcatccgccagagggagacccgtggtcccactaacatatgtgctatgagagctgatttcctgtctcaccataggctccatcttttcagagaggggtgctcacaaaaattagagagtggtcagtatggtcaggggtctggaaattatgtcctgagggaaatagttaagggaaaatggaaaaaatttagagggaatatgatagcaatcttcaaaaatttgaaagattatgtgagagagaaggagtgcaaatatttattatgattgctgtgagaagaattgggtagaaatttcagagagcctaaatactaaaaaattaaatatagatagctagatcttcctaacaagataaaagtgctacccattactgggtgtgctcatggggaaggtatataattgcccacctgcattctgtatgttggtctaggtgacttgtaaaatttccttctaggccgggtgcggtggctcatgcctgtaatcccagcactttgggaggctgaggcaggcggatcacttgaaaccaggagttcgagaccagcctggccaacatggcaaaaatcccatctctactaaaaatgcaaaaaaaaaaaaaaaaaaaaaaaaaaaaaaaaaaaaaaaaaaagccaggcgtggtggcacatacctactacttgggaagctgaatgagaatcacttcaacccaggaggcagaggttgcagtgagccgagatcatgccaatgcacgccagcctgggtgacagagtgagactgtctcaaaaggaaaaaaaaattcttctaattgtaagttgctataattccgtggctcatgggtctatgagtagcaatggtgtctttcaatctatagcaatcagtagcaatggtgtctttccatctataaccatatcaatttccaagggagagagaataccaatagaacttcattctacatttaattactgaagagatgcaagctttaaagcttatcaaatagttgtctgtcatatgactaaagccttccttcaggaactacacataaccgtagagaatgttactaatgaaacactgcctacattctttctgtatatctgctatttctgcagttctttgttagtaaaacaccatttgaaacaatgttgtcaaagcattccaaatatcttacatcaagtgtcatcttctcagagagtacttctctaatgactcaatctagtcctgagttactttccattgcattatcttgttgtctttttttcatatttaagactaactactaacacactattcatttgtttacttatttgttgtctgactcacttcccaacatagaagcattgtagagagggatcttgtgtgtcttgttcactcttcctctagcattcagaaatagtaccatcatagacatatcttaaacataattgaattaatgaaacatctaggttggggcttgaggtatttctcaaaggtaactctatccttgctacagtgtttctggacctttctgtataatttaagtaatctacactgaagctctgatgtatttgccatggtgacagagtataaatgctactacctagtctttaagagacatttatgaatttaaaggcaatcagtgaatcttcctttggttatcctatgctatgaagaatattcccagtcgcactcacttcatcttagttttgactttgaaatcctttacaagttgaggtttttatgtgaactctcttcctcttctccaagctacattcttggttgcagagctcagaatttcacatggtagcttcttccagtcaaaggaccatgtggttatccagataaaatgtcttttcctaggtcatctatccattttataatatcttgggagctaacttggatgagataatcaactgtggttgtcgttcaccctactacattcccctagattgcctttcaaagtgactttttccttttcctcaaacctcctaatctcctcctctcagcagatgactttgtttcatatttccgtgagaaaacagacatcatccttcaggaactctctcatcttttcatcacgaattcatctacttatctgatcctcactcaccctttcctaccttccttcctactacccttgatgaagagccctttcacttatctaaggccagcacccacttgtactttgtacctgtctcatcttctaaaggattttgattctgtgagtgtccccatatttaaggcatgagtttctaatccctacagggttatttccatcagcacataaataagctatactatcatttatcttgggggtgggggggaactccagcttcttcttcattttctagtttcccttcatagcaaaagttcttacaagaattgtctattagttgttgtctttgctttctcacattttctgcacagcccacttcaattagactttcttccccaacacttcacccctattttcaaggtcactaatcactttccaattgctaaatccagtggttattttgatgctttaattttgtttagccttcccctgggatatgtcccaaattttcctttttaaaatactttttgtttcttttgcttttgccttggattctgttacactatatatctgggaaatcctgaaacatagatttttgtaatattgaggcatttctctcagaagaaaccttcccaggagtgagggaatctggacagggcagggaaagaacctggataaagaggtggttccaggagaaatgtagtctcagcccaatcccttcagagctttggggcatgccctgcagcacagaggcaaaggggttgggctgttatgtcctggcatctgccatggtgtagcagctgtctggaaggatggagcagaggcacaaccttccaggtaaagcccttccttgcagttaagggaaattcttccaagaagggcgcaggagaaagtcctcacgggataaattcatggtagctgcggatggagcacgactcagctgtgggatgtggtgtaccagatgctttaagtggcctatctttgccttctacttcagccactcctcagtcagttcctctgctgggcttgcattctcatctcttaaaattccacatgatgccttttacttactgaaagctcacaaatttattctgtgctcttgattactccggagaaccctagaattacatttacagctcctacttgacattttcatttaaagatctaaaaggcttcttaattttaacagggataaaactaaactcttgattccttgtccctcctccaaacctgcccttgtcccagtttccccatctcaggtgctcaagttccaaagttaggtgctactcatgattcttctatttatcttacatcatacaacattctggctcttcatccaaagcatatcccaaacccatccacgtctctccaggtccaccatccactacctagctaaagccattgcctcttgcctgcaccactgcagtattgcctctgtgttctctttgtgtttcacttcttgctacccctgcagattctgctgtacagatgccaggatgatcctgttaaaacacatgtcaaataatgttacacatatgcttaaaaccctacagtcatttctcactgaacttagagtaaaatcccaaccccttaccctagtttatgaaaccatatgtaatctggcccaagtatacctttccaacctctttttcgctgagtgttcctctacctgcagtgctcagccacattagctgcatctcctggggctcctcaaccacaccaagaatgtgcctccattggggtctttattttgacaatttcttcttccttattgtcactcagatctcagtctatatatcaacttctaagacaggttctcctgatcaacaaatcactttctcctcactctttaaattgtctctagaacacttaatactgtctgttatttttgtattaatttgtttagccatttagtcattggatggttgctttcttactgtgtaagtgccttgagggcaaagatgttacatgtcttatgcatgcaatgaatattttttaatgagtgaataaatgaatggtgacccacctgctttaagagatatgtattcacttagaatatgtgcagtttagactgcatttttaagctgtttgtttatggatatatttctaagcatcaaaaaacccacaaaaaaacaaaaactaaaccaaaactgaaacccaccctgctttacagtcaagattgattataatctgtgatttccctttgacatatgatgaaatctagttactatgtatcttcatatatctgggccagacccttatattctgtaaaacacaatgacaaaaatatatctaactcttatgtaagaacttaccacataacatacaaaatgagcactgtacagtatatgccctcagaaatacacagaagagcattgatagtgtgggacattacaagctgtttcttgtttactttaaaaatacatgttaccatccctttttttaggtgataattcaccatgagtctcacacttctgcacattctgttaacagaggcactggctggctttgttttggaccaatttttccagtataattacatagcagacaagcttggaaattagaaatagtgtctccctctggaccgaagggcaggcatggttactgcccatcataaaagattcatcataaaagatttgcccatcaaaaaaaactcattgttcctgttcagtaacacagcctacttcacatctaggtatctctttgtgttctttgcattttcagtgcaaaaatagtaatattctggacacttctattgctctaagtagtaaacggtcccttgtatctttcccaggggtctcatgttttctaccagcattcatgaaactgtggcaggttcacttgttagcttgtaaactgggtaaaatcttggacctttcacaatgcctgacacattcttgcgtatctcgccagtcctcagggagattttcttgggctgtcagtactgctagactgctgtgcatgtttcactaaatttaggcaaaagaatgaaatctaccttgttttggaagagactgcaaatagtcactttgataggcaaataatggacccccaaagatgcccacacctaatcccccaatcctctgaatgtgttaggttatatgacaaagggaaattaagggtgcagccagaagtaaggtggatagtcagctaacctggagaatgggaggttaccctagattatccaggtggacccagtgtaattatgaggtttttaaatgtggaagagtcagcattagtgtgatatgatttgaaaaagacttaaccagccattgctggctttaaaggggaaagtggggcatataagccaaggaatggaggctgactctgaaagttaggaaaggcaggcaaacagatcatcccctggagtttccggaaaggaacaccagcttgattttagtcagtgagactgtttctgatttctgatctccagaaatataagataaatttgtgtcgttctaagccacaaagtttgtggtaattttttatagcagttataggaaaccaatacaattacagactctggataaaatagctacatgaatgtattttaacttcacatttacaatagaagaaggcctcaaacatggtagtagatgtattatactgttataaattaggataatggtaattcttagacaaaagcacatatgcaagtaaaacctttaccatgaattcttaggatgagaaatttcattttaatatcaatgtatatttctttgtgttaatttaaatcattgtcttacatccataacaagtactaagtgacatttaaatataaattgtgaatggcttcagttttcttcttaatttttttggttttatgtaaattcattagtttgttaaaacttccaagattccttttatttggcccttactattaaaattctaaagtatgcaattggtaattaaacctgaatagtaaattatgtttaggagtaaagtaaaagactctttgtattttggaaagtataattagattttacaacaaagaatattactatatttttgggaacaatctgtatcacttatttattggattacaacatcaaggaggaactttttaactcccgttatgtgcagttcttcctaggcctgaccaatctgttctctgtaggacagataactgtagggtagatcttttctacgctcattataccatttcaatagtttgttttctaaattttgtgatcccacagagtgacatcacccacagagcccacacagcctgcagtaccaggctgtgtacatgtaatagagtggtcttatggcctagctcatttgggagtagtatgtcaggaggacctcagatctttggctatgtttctgttttcagtaacttagctcctttgctgagtgtttaatagtttgattctataggtcacaaggttcagatactcttaaattgttcaaatgatttataaatggatcatcggttgtggttttacatatccttgggatggttagtaatataattttaatgaacttaagtgctctaattaaaaattaaattgtgctttaattaacataaagtgagcatgaagctcaaatgaactttgtttgtaaagataactttaggtataactgaaataattgtttaaaaatattttgaagttttcttaggttacatagatgtgagcaagggagcttaaattatttctttttttcatttgaagttggatgatatatgagtccattaaacctctatatgtttgcagttgacaacactaaatctgggaaacaaccttttagaagaagttccggaagagatgaaatatcttacatctctgaagaatctccatttatctggaaataggatctgtagatttgcacctggagcctgtggtaatttaatcaacaaggaacaacattatagcatcaaatttaatctctcatatttaataatatgagactgaaatgaaaaagaattttgcatgtttaatctttttttgttggagatatttacatactactcttgaaatataggaggagacaacacttttaaaaaagtattgtatcatatgtttatttacatgtagacctaagaaaataagtaagcatcagtgttaatgaattttcctctttgtagaatcagtataaagtcagattgtgaatctggggacccttttcctaagccagagataattctattgggaaatcaaatcaagtaaagctatactgtagctttgttcttttcactttttattctgtcttagatattaagtcacactttttgatcaagatgctaaacttaaatcaatttggggagaattttaaagaaaagatatgagatccaataagcatttttttctttctttttcccattaactaataatttctccattcaagatgatgctattcttatttaatattcctagagtgggcttaaggacaaatgtatgacaaagagatctacatggcttttatagctttatcaactaatgtaaggtacttcaccactttctgtgttggtccttagtagtaaaatgagagaaatattataaaatttataaatttctatgaacttttgaggcatgggtgctatatataatcattgtcatcttcacacagagtttattaatggcattactgcatgcagcaataaattaggggttatatttggcaaatagcacaagtagactctagtactgtctttttaaaggtactttaaaatcttaggtcatgtatcttggaacaatattcttttccaaaataatagatgtaacaaacaattattgaacttgaacaccttatatatgcaaagccacagaccagagttcagttacaatttaccttggaagaaaacagtttacactaaaaaagttaaggtcatgcaaatcaatagataataatattttatgacctatactgaggggacaaatttaagtgcaacctgatatacataaacaatattgaacatactaatttatactaattaaggctctataaggaattttgtatcatgttgcctttaaatttgaggtaagttaggtatatatatatctgtatctatatctgtttagatatattttatatatgtatataaaatttgtttggagtgctcttgaatgtctttagtttctatatttctttttaaaaataattatttttttaattgacagataacaattgtacatactcatggagtacatagtgatattttgatacctataatatatagtgatcagatcagggtaattggcatagccatcatctcaaacacttatcatttcttcgagttgggaacattcttgacttggggttattgaactttgaaaatcccatgtgattgacctaagttatgttctatgtcaggtcctgatgattcaaggtcagaagtagtttgatgtcagggagtttaatgctgcccagcatgggtagaataaccttgttgcattacatgaccctatttccctgaccagagcagattgatcagggctggagttgggtcccaagctaagcttgtcatattttctctttcttgggaattgtgatagagtctaaaacagtttaattggtttgagataattacatgacctgaggcagagattgcaaactggtggcccatgggctgaagctggttcataaataagttgattctattttttttgcctttaaaaatctttgaattaggtgcccatgttttcaaatcaggagagttcacaaagaagtctggatctctggctctttttaaaaatctgttttaaaaaagaaagatttagcaacactgcagttgcgttcccatatgacaattgccagagctggctgaatggtggtggccctgtctgacatggcatgggattatcattttgattcctgtggacatgtgagtttgaaagctctgtcttccctgtcaatgaacattcaaattcagaagttgtgatatggttatgagtacatagaaaaatagagcaaacatgttcaaaagagagaatggagggaggaaagagagagcgggtaagatattataaatacgaaaatgagagaagctgtaatgaagaactaaattatattttctgcagagatattcagacagtacattctcaggttctgggtgcttttagcttctgattccagtttttgatgagcctggttgcatcctcattccacaggcacagtgacttagatttgtaactttgtgataaattactcctttttgcttgagctagtttaagagggtttctgttaccaccaccaaaagagccttggccaaggcaagaaccagaaggaaaacaaaggtatgtagaaaagtagaaaagtgactaaaaattatctaacagatggctaaagtgactaaaattattttctaacagatggcttacaaaatttaatcctgcttaatctgaacaacaatcatcttacgcagcttcctcaagaagtcagcaggtaattttgtttatagcaagacttggttaacaatcgtgcccctcctctatccccaccctggtcatttgaaagcattatgcctagcataagtccctgtgagatttatacatagcaaagagggatctgaaggactgaggcaagccactaattttaagcagatgattccttaaacactttggagaaatgagaaacagcatgataatcttagtgtaaacattgggctttgaaacataaagttctaaaactgatggtctcattgatttcccaactctgaggttcttggagcttggttagccacagaattgggcacattaaatgttatttcgcatgtgtattgtaaaccattttgagcttgatggaaaaggtaatgtaaaaactaaggatttaaaactgcaatgtcattttcgtttttaaaaaccccacattttattgtcattaaccaaaaaaaaaaaaaaaaaaaaaaaaaaaaaggctgtttttccttatcctgcatatctgcacaggcagaatgcctttctggagccagctgagagccttgtccttctgtaggcaaaacacgctcttgggcttttcctctgacagatggagagagaactctgttcaggtttactttggagactccctttattgcctgttgagcagaaacagatgtgtcacagagcaagagcagcatccagggttttaaaagagaatacaaaactttgaacagtcctcaacacagtgctttctgcagcacctaacatctattccaatttacttgtctatacctctggccaatgtattattttttccaaatatatttttataaggaaagcaatattttaagtcagagcaactagaaaagaattgaatcaatctaatttctataaaagataaatatttgcagcaatgaaaatgccatgctaatagttgtctgcttgcttttttacaaattcagcttatcaatcgatgtatatattgatgatgatataattttaaaaatcccttgggagatctcatgaatgaggttcagggcatatctctgtgcaactagatttatgcctttggaccagtaatttaactactttgaactgctgccttctcatctctaaagaaagaattttgaatagatgaacctcaaagtttttgcagctataacacgttatgatttcacaatttcatacacttatctctgtttggaatacaaattacagtattcaaggaatcgtaaatctaagggaatatgttagaaagatgaaagaatgctttcactgaagaaagtaggattgcagagtgtataggtctattctgtcttatagttaactctggattgtctatattctggccatatcctactagatatcaattaattggtcatctctctaagtagaattccatttctgagcctgggaaagtttcttcactttcctatatcttaacatcttcacctgcaaaatgaggatgatgatagtattttcagaaaataaatcggattgttttgacagttaagcaaattcatacaatatatttagggttgagccttggacataaaaggtattagggttgagtaagtgctcaatggatgttagcttttattattattggttgttatttttattctagcttctttctgttccctttgttcactgatttccagagacaaaggaatgacttctcagtggatttgggcaaagcattgagcatatgtagtttggcattctcctcttgccctgccatgaagtaagcagcagcctcagcaggaaaggctgtgaatggggtggtatatttaatgcagaggagggctagcagggactcagagtgatcatgtcagctctgtgctgatgtttgatttccttctctctaaattccatatcttatttctcaatttatttagaacttaggagagggaaaaggagttttgtttttggctcatttaaactacagaatatcagttcatggacttggagtcaaatttgggcaggtaagagttttacacctaaacagctctgtcatggacagcgctgcacaggcacaggaagaggacagcatgggcatcctggtgacagaatgagtctggaagacagagagagagagcaagggactaagtcagcaggctcagttctttctccaaattcgtcagtcagtgaagttgttcttcaatctcctggggaagacagatgtcagggagaatctacaagtgtatctcctatagattttctttggaaaagtaggacatctccctgctttgtggaatcgggaacaatggcagatatttgtttctctccctgctctttactcacacaaatgaatgatggacaaatgaacaataggatctgagctcattttattgccttgaaagaacaaaaaagttaaaaccaactcccatgatatagtaaatcagagtagaatcaataaaaatgataataaaaatgattataaaaatgattaatgaagaaaattccccatccctttccccacaggacctgctccacacatttttactccatttcagtgctgagttgtccttctttgaccctttatactgcaaagaacttcacttcctattatcctgagaaatttgagctccctcaatttccttcttttcagcatctttctctccattgttctatttctttccttcctctcgctcttgcttccttgtcatctctctctgaagtcccgtgtcttttgcttttgcttcctgtgtaacacattgtaaattctcttctgtcttctccattctaccttagatcattttcaaaagtcgttactgtcctttacatagtcaaatataatggccttttttttctgctgaataaaaattacataaaactattcaatgcattttgtactattcaatgcattttgacaaatgtacgcacaccaataagatgtagaacattttcttcagcccagaaatttcctcatacacccttccagtgaattcttacctctcataagcaatcaatattctgatttctgtgttctttacaaattagttttaccaatcctagaactaaataaatggaatatggtatatacatttttgtgtctgtcttcttttgcttagcatattttttgagactcatataactgttgcatttattagtagttcattggtttgttttttgtttttgtttttgttttttattgagacagagtctggccctactcacccaggctggagtgcaatggcatgatctcggctcactgcaacctccgccttccaggttcaaatgattctcctgcctcagcctcccgagtagctggtattacaggtgcctgccaccacacccagttaattttcatatttttagtagagatggggtttcgccatgtctgccaggctggtctcgaactcctgacctcaagtgatctgcctgcctcggcctcccaaaatgttgggattgtaggcgtgagccaccatgcctggcagtttttgtttattctgagtagcatttcattgcgtgaatatgccctaaatcatttgtcttttctcctattgatgtacatttgggttatttccagtttagggctattatgaattaagctacaataaacattattgtacaaatctttttgtaaacatgtttaatttcattttcatttaaatttctaggagtaaaacagaaatttatttctcatagttctggaagttgggaagtgaagaccaaggtgctggcagatgtgatgtctggtgagggtctacttcctggttcttagagtggcacctttctcactgtgtcctcacatggtagaaggggcaaggagctctctggggccttttgtaaggacattaattacatttatgaggtttaccccatcatcatgacctaatcatctcccaaaggccccatctcataataccatcacattggagattagattttaacatatgaattttgaagagacacaaatattcagaccatagcactgtcatttctccaataccatatgatcttgattatcttgattgctgtagctgcattgtaagttttgaaatcaggtaaagtgagtcttttgattttattctttataatagtttggctattctaggtcctttcaatttccatataaattttaaaattgatttgtctttttttttttttgttttgtttaagatggggtctcactatgttttccaggctggtcttacactcctgggctcaagcaatccttccaccttggcctcccaaagttatgggtttacagccatgagccacagcacccagcccaagtcaagtcttatacaaaaaaagctgtcaaaatttgtatttgaatctattattgaatctatagatcaatattaaaaagttgatatcttagcaatattttgcttttctatacctgaatataatatatctctacttttatttaaagcccctttacattctctcattcataatttatagttttcagtgtagaggtccctcatgtcttttgttatatgtactcttaactatttcatgaaggtttttttatacattactataaatggaaatcttaaactttttattttccaattgtttgtggctacaatatggagatacaatagattttttaaatattgactttgtagtttgtgactcggcattatttctactagttttgtttgttagtttggattatctctctttaacatttaaacttttgaccatctctttaattttgaaattttcttttctcacaccttcagagattccttgctaatctggttcttcttctacttctgtgttcataactttgctgggtgcctttaatttttaatggtcagttgtttatatttctcaagaatctttctgttggcttcctctctcttctctctgcccattttcttttgttgtttttcctatcaatcccaggtattcatatggcttctactatgtacggagagatctgtagaatcctcaaaattccctttgctagcactgatgacttcctaacctccagtctcccattttcaactgcctaaaaatttagttccctcattcttacattacttcaatcttaacacacttcaaccttgagatcattacatgttttcactcttagctttgcaaacagacacacctgcattagaattttgacattgttacctactagataggtaacttggggaatttatttactgcctctaatgctttattttcctcacttttaaaataagagtagtaattccaacctcagagtcatgttgatgattattaaatttaatgcacaggcatgtagttgtgcttagtaatgttaattcccttctgcttccttattcataatatttttcttagcttactattccctcttattgccctattttataagttcttttattcagggccaaattcaaaatgtcagttctttagaaaaacttgcaatatgcttcaggaaccatatctgcaattacagactcaaatttccttaacctttttctccttagccaatggcatttgctgttctcagtttgtggctctatttaatatctcctaaaccagggcatccaaaagggcagaatttgtggctgattcatctttgaacttccacagcaattgagcagtactcatatctatttggtactaggtatatttatgtctatgtatgcttatgcctgttcctgtattgatctatatacataggtatgtccgtgttctccttgtcctctagctttctcttgggtatggccaatgtatatgtataaagaaaggaaatataattttctttttctgaaatctaggttttgattacctaacatacttttaacataagccatctgattacaaaagatctttaaaaattaaatttcagcaaaaactttttatactcatgatcacaatagttgtaaacacttgactgaagtaagctcagaagagctacaaaaaataaattgacacatggcttctgctaagttgggcctatatagtggactcttattcttgtgagtttcattcatatactttggtgtttttttttttttagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggtaagcaaaacatggaaccacagtagtttgctgttggagaagaactcaacatgatgggaggtggttatagattagatttgggtatctgagtataagccaccacttgctttctctcagattaaatgtagtcagttcccaaatccctatgacagaagaaggctataatttgaattatcccacatagctagggctgccagatttagtaaatacaaatatagaatgctcactgaaatttgaattccagataagcaatgattaaattttttactataagtatgttgcaaatattgcatggaatagactaaaaaacctatttattgtttggtatttctttctttcttctttttgagacagagtcttgctctgttgcctaggctggagtgcagtggcacaatcttggctcactgcaacctccacatcccgggttcaggtgattctcctgcctcagcctcctgagtagctgggattacaggcagacaccaccatgcccggctgatttttataatttagtagagacggggcttcaccatgctggtcaggctggtctcaaactcctgatctcgtgatccgcccacctcggcctcccaaagtgctgggattataggcgtgagccaccgcacccagccttgatatttcaatttaagtgagcattatatattttatctggtaacgatgtatacagaacaaaatacaagttcattttggctttggaatatgtactggctctccttttttccttcatattcactttctgtcctgccttctgcttgggagactgacctgtgtgggcagcagtgaacttctttgtcctctggtttcctcttggatatggcagatgagaggcactagcaggaagtgacagggcaggaggatagcaagtagttgatggtattcataattatggagactgagaagtcctacagcaggctatctgcaagctgaagaccctggagtgctggtaatgtggctgagtccaactctgaaagcctcagaaccagggaagcaaacggtgtaattctcagttggaggtcaaaggcctgattactgggaggttgtggtggtggctggaggggaggggtactggtgtaaatcttagagtctaaaggctggagagcccagcgttctgaggtccaagggcagaagaagaagtgtcctagctccaggagagagaggaaattacattttttttttcatcaagtcactaactgataggatggtgcccagcaacagtgaacatgtatctttcccaccccttctactgactcacacacccatctcctctagaaacaacctcacacagacacacccaaaataaagctttaccagcattgtaggtattccttaatccagtcaagttgacacctaaaattaaccatcacactagacttcttatagttctatcccaaacaactgtttgctcttaatggaacatcatttgttccaaataactcagagaatctcagcttaaacttcactttttccaggaagcctttcctgacctcctaataccaaattttccatatatcactgtttccttaacccttcgtaacacttctcattctcatagcacaactttgtccttgcctatttgtgagtttttaaaccttcattgaatacttgtgaggggtatacacatgcaaagatttgaaaaagacagcaacaaatatcaacagcaataatagtggcagtcatggcagcaaaaacaaacaaatgaaaatgcaagagtcgacagcaacggaagtaatgctatgaagtgttttcaagtagggtggaagcccttatatcataacatgagatactgaaggaacacattggagtctgaaaatctctgcagctaaaacaatacaaaggagagtatcatggcaatggaagactatgtaggacttaagaagaggactcccttcaaggatttgctgcctagctgtagggaatggggattgcagacagcctctagctgttagctctttcagtaacttaagtaatccattcaacaaccgtatgacttaagggcttctattagcattttcattttacaaataaagaaattgaagtacaaagcaattaagaaatttgcccatagttatagtacctgccagaggtgagatttcaacctagatgtagtgtaactcacagtggccatgttatgttgccctggagtggtcagaggaaatgaagaattcaaagagctggcagtccaggatatgggggtctgctcgggaagatgtgctgaagaattggtcagtacagtgattagaaaagatggccaccttcatcatgttggagctttaaaaaaatttatgattttccttatgattttaaatattagatttaaaaaatctctctcttctgttttctgacacaggaactttgtgatcttaaaaaactaagaatcctagacatagctggaaatattattcagatatttccatcaggagtaagtagagtcaacttccattataattgaaaaataattttgtttatgctattgggaatagaaaaaatatgggcagacagtaaaacctgtagtaattgaaaccttaaattatacaaatgactcaaagatttgcttttagaatttcaaaacctgttctctcctgtttttttctttgtgttctgtgcctgctgaacttgtttgaactaagttaactctgattgctatcacaaatattttaatatatcagctatgattaaattttttggttattacacactgcttttggtcacctctggctttttgaaaatattactttctggagcataaatttttatcccttgtaattaatccaaaggtgacacttttgttagtcatttttaggccataaacaatgaaaaatgcacttttttctcatttgaaaatgaattttgacctcattttatttcaaatatggagaaaccgtttgtcttggcaactcctaacttttgagaaagaaatgtcagtttttcctattgcatttttatatccaattgaacatgcttaaacattcatggtaataatgagaagtccatctatccagaaggtattcaatgaatagttgttgacccattaattatttttcctgatttatcccctctaaattgaggtttcagtctttttttacctcctagagcaatattttatactgaaggtaattcaaatataaaaaaatgagtgtaaagtctatgttttagaaaaaagtatagtttttaaattgtggcaaaatatacacaacataaaatttaccattttaatcatttctacttgtatagtccacggtactaagtactttcacattgttgcacaaccatcagcattatccatctctagaacctgttcatcttctccagctgaaactctgtatccattcaactccaactccccattccctttgtacacctattttagaagttcctataaatactttgaaataagatctttccccccttcatggcaaccacatatctactatatatctctgaatttgactactctaggtactctaggtaccagataagtggaaccagatatttgtccttttaccactgacttatttcacttagtaaaatatgactaacattaatttatcttataccatgtgtcagagtttctttcctttttaaggctgaataatattcagttgtatgtatataccacattttgtctatccacaggtatctgcccacctgtgggaccttgggctgttttctcattttggctattactgcaatgagcatgggtatacaaatatttgttctttatctgctttcagttcctctgggaatatccttagatgaaattgttgaatcatatggtaattctatgtttaattttttaaggaatcaccacagtgtttccaaaaatgtgtagatttgaatgtttagtaaaaattggatattgttaatattgaccttgaaaatgtgacatggttttatttaccctctgtgtcttaatttaactctctatgtcctgcgatgccttctggtgccacttcttctatggtacccctggtgccactgctacttctatggtatcttctggtgccacgttttctacggtatttctatggtatgcttgagcaacataatggagtaattcatttcaagtctttcttgcttttggatggtaaacttccagagaaagaatactctttttttcctctatacctgcagtgtcttgaattttaactcaataagtgtttgttaaatgaataaatctaactgatgttcttaaacttcatttattattcacctttcaccttcgtagtctgttaattgaccgtttcttctatgaagtgattctgtacttaacaattttgataaaacataattacttaggtcccaataatttggagtaattttgacaggtctgagttggtttcatctgtgtagtacctatttcaggaatttctataaacactctcacataagatgatctgcaaactcatctgagctttggtccaaccatttcaaattattttggttcaactgattcaaaatcaaagtttcccacattaaaaatatggcacaactggtggacctagaggagaaatgaccgactctaggtcacacaatgattatcagtgaaagagagtaagtttcaaaataatggtagagaacattcaaaacaagccatgctttttgtgaaacacagtagtgtagacatgaataacatagactttggagtcatatacacatggatttaaagcattaatttcctattttctaaattcgtaatctcaaacaagttgcttcatttctcagagttgctatttcttcatctatataacgacaatattaaaaccactaacctcataaggttgttatgtcaaatagtgattatgaagcattttgtgcatagttggtttccaggaatagaaactattatatgttgtgtataaaatatataccaataatgaaatactaataagtaatatataattatagcaatcatctactctctactggtgatgataggaagcattaaccttgtgaagtacatttttaaaaaccttttttaactatgagaatattcaaacatatataaaaacagacagaaaagcaaaataaagctctgtgtacccattacttttaagtgtactcttaactcaaagatttgaaactgcattgtgcataagtgcctttgaatagtttattttactgccttataactactttttaaaataggtatttatttaagagtgttttgctattttatgatttaaataaatttggtgtgcaatttagaaaatgcaatttttttcagagcagtatttttttttttttgaaattcacatggcatttgaacatttgaaactgtatttgcactaggacttttgtatacgaatatacattaaatgtaaatttacagtaaaaaattggactattataaatatttgttcatatgtgttggatcaaaagagtttctgtgttatttagttcctaagaaaaaatctggcatgaccacatagtgaattaattgtttcagaaatggccagatatggtggctcacggctgcaatcccagcatttcgggaggctgtggcgggaggattgcttttgattccatgagttcaagatcagcctggacaacatggtgaaacccctatctctacaaaacaaacaaaccaccaaaaaaattagctgggtttagtggtacaccctgtggtcccagttacttgaggtgaaagtatcactcaagcctgggaggtagaggttgcagtaagctgagatcatactccagcctgggcaacacagtgagaccctgtcttgaaaaaaaaaaaaagaaatatcttggttcttttatgaacatgtagtcagatctgctacagagagactttagtttctttccttacctcttttttcctttcttttattttaacttaaaaaaataaaacttaaaaattttgtaagttgtacaacttctgcatgtttcttaaaatgtgaagcaaaacaaaagtatggaataaaaataaaagtttcggccgggtgcagtggctcacgcctgtaatcccagcactttgggaggccgaggcgggtggatcacgaggtcaggagatcgagaccatcctggctaacacagttaaaccccatctctactaaaaatacaaaaaaattagcagggcgtggtggcgggtgcctgcagtcccagctactcccagctaattttgtatttttagtagagacggagtttctccatgttggtcaggctggttgcgaactcctgacctgaggtgatccgcccacttcggccctctcaaagtgctaggattacaggcgtatgtacaggagaatggtgtgaacccgggaggcggagcttgcagtgagccgagattgcaccactgcactccagcctgggcgacagagtaagactccgtctcaaaaaaagaaagtttccgttccaggacctcttcatgtgtgtttttagaaaagcctgttaaaacatttttttcacacgatactatgtctggattggtttcattatatttaatttcccagtatgatttttctttctaaaaaagtaccatctggccaggcgcggtggcttacgcctgtaatcctagcactttgagaggccgaagtgggcggatcacctcaggtcaggagttcgcaaccagcctgaccaacatggagaaactccgtctctactaaaaatacaaaattagctgggcgtggtggctcatgcctgtaatctcagttactcgggaggctgaggccagagaattgcttgaacccagaaggcagaggttgcggtgagccaacatcattgcaccattgcactccagcttcggcagcaaaagcgaaactccgtctcaaaaaaaaaaaaaaaaaaaaagtactatccaagtattctccataaggcattatcaatgtatcaatagcagaaagatcagcgagagaaagcaaaactctgggggctattttgatctgatctatctatcattgcacaattttagaacattctcagttttctcacatacaattttttgatacctaattcctgtctgagacataccaaattatttattgtattagtttgcaagtgtcctctgcttcttgaatgaatgggtattaagatttaagatgttgtcttcatttatccttttgtaagtagcatttttctggtaattcattcattgtagaaaataagtaaataagtatagaaagagtaaaatgtaaggtgtctttaagtttaccttccagagactacactttattgttttcttcaagaatctcatttttatattctcattaaaaaaattcaatgtatactgcataaagaaatacgtgtcttgctttgtcattttcatttaacattatatattaagcactttccttaaatgaatattcttcaatatgtgattttttttttttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaatatgtgatttttaatcattgggtgttcttctaccttttctttatcgtgtgttcactttttctgacatttttatttattgctggaattagaattggattttgaatgaacaagcctttgagaacaaggatgatctgaaataaaatgtcttttatttgtatctgtctttcagagaataacatatctgaagtatggcctttagtggacactggacaatttatggcaacactgtcggttgttcagttagtgcaggaaacagtgatgcttgttttattagtttcctgaggctgctatagcaaaatatcacaaactggggcttaaaggacatgtctttgttttctcttcttagaaggataccagtccttggattgtggcccactctaatccatatgacctcattttaactagttacatctgcaaagactctgtttccaaataaagtcacattctgaggttcagggtggatatgaatcttggaggacactatttaacccattatacttgatagaacattgagtttattactctatttggcatctgcaagggcaattgatataaacctccttgatgaggtttatatgactttccaattccataaacaattactgagtaccttctctgttgccaagctctcttctaatctggggaagtaaatgaagaaatatggatgttgctgtatagaaactttggaatttgtgtttgaagaaatctctaaacattgaagtggaacctggagatatcataagaacaagataaatatgtgatttttaatgatgtacagaaatttaaaatgagaaaaatcaaagaaactggcatgaattagcttgaacaaagatgcaagtcagctaggtggtaatttcattgttgagttcaaaataataaggggaaagtgacctgttgccttcataacttttgatgatggggaaagaaaaaacattattatttgctgctgaagggttttggataggctatcatcgtgggatttctgggaagaaaggattactaatatctttctttaggtcagaaaactcagtctatgaagtagttgtgattcagtcttttcaacagaaaaaaaagtaaattattgaaattttatatttcctttgaaacagtttttattttaatcttttagtcacaggtcttctttctctagctcctctttccctcaggagccccgttatttttcaaactgcaatcatttgaagaaaaagatgacctgacaaaagcaagaaaaagttttaatgatcatcaccagggagcatcatgagttttgtgtttgatgtgaagttcataacaaaatatcatatataaaatattgcagaccaaatagaaaacttcacatttaaataagctcttagaatcctccgttagcaatctatctaacaacctgtactattatgactacttttcaaattcacaaaaagttatctttctggatgaatactttgctgttatctaaaaatttgcaagttatcaaatctatttgttattgaataattccttgaagaagacagatttggtatcattattcctgtttggagctgaggatattgaggctccagagtagtttgtccgcagcagtgaccctcaaacttgaatgtgcatcagaatcccctggatgccttcttaaaacccagaaggctaggccctccttctaggatttctgagtcagtaggctggggatcccacaggtttgcatttctgttatgttctttggtaatgctgatgctgtaagtccaggaactacacttggaaaaccattggcctaaatgatggaacagtggcagaggttgaacttgcactcaagacttttggctacactgtcaggactccttctgcctctgaggaatccattctttgtcccaggttggggcagtctctgtcatgctatacaaataaggcatttctttgagctcactgggagtttgggttctgagaatttcactgtgtccttgactaaaatgatactcaaggaacattctttggacaatagaattcttgtatactctgaaaaatatttcacatagaaactaggattttggtatgtgaacacaaggaatgcctatatagttggaggctgagttttatatgttgtttaattcggttagccttacttctttttagccacactgtggatgtactcggtgcatatatgccacggacaaaacttcttaaacatttattcatcagccaatctaaaattggagagattttttagcatgtgaatttaacactaaattttattttggagaaatttggggaaggccaaatctttaccatgttactttcgtttctgagttttgtctttttaaagttcaccctttgccttgggtggttatagtttgggagtgaaactcaagtgtagctaaaacatttacaaggatacaaataaatgtgacaacttatgagaaagtgctttgctaagagtagacacttaagaaatgtgcttaaaaagatgtaaattatacccaatgctacattttccacagtcactgctttctttcagtttcaaattcatgatttaacattcatgtgaatctgtagcttccataaacacattctgtgtcagagttaagaatcttaagtatttgtatatccctaaggtttgtaggcacatactgtttttataagaaaaaaaacataaagcgggaaagcctcatacaatgttgtcatgagaaaaagtatgcttggactatttatgggaaatcatagttatagcacctattccgtttcatcaatgccccttttttccttcaagaattctttagagttatcataaataaaatttgagaatactgaaagcagtttcctcttttacagtatgagaaacacaggaggaaaaaaaaatggaagcaactttcccagaaatacaaatcatttgaatagtgaggagaaggtttgaatccatttttcccaaacaaaaattaaatttgcctagcttaacaatgtacccattgtgtgaccttggagaggtaactccattactctatgtctcacttttttcctctttaagttggggatattaataacacttgtatacatcacattgttaggaaagtgtctcacataacatttggtggtcagtaatgatagaatgaatgaataattaaatgagataatgtatatgaattcttattagtgtttggcacatgacagatattgaatgttattttcttgtcattttaaggtttggtctgagatacctgcccctcaatccaccccaaattttggggtgtctctgaaggctttcaaagccatgagatcacctgaatggttctaattcgtaactgttactgtaaccaactgatctgtacccaagggtgtacaagggtggctggtttcagcagtgcactctgctttctattccccatgttgtctttgcccctgttccaggttattttcctctgcagattcctttacattctttaggcttaccttccttgggcaacaaaacagaaccaataaactatctccctgaagggggtctcctttccctggctccttgcctttggttttctgtttatttctgtcttaccctttccctctcccttgtggctcatttggtttgtttgccagaccagattcctctggaaataggacctctcattactgaattccctttttcttagacacttcacttaactcgttgcctactacttatcctgacgtctcttcttttcttggatatttttaatttaaaaggatttctctttttatacccaatgatgaatgattttgatccacaccagtctaagcatatcttgctatggtgtccttggttccagacacatgcctgatatctagcatggtacataccctggtttactgtcactctctgtctgttacttgtctaattcaaatactaccggtatcttttgttagtacataaatattttttgtgcttaatacaaaatcaagtgaagaaaaccattttatttttggatgattctcatttccaaatgaattcatctgccttcaatagaatgatttccatatatgagcagtaacacaaatatgtgcacatacagacaagcattcctagggagaccatttagttttgcattaacagaaatatttctgtgaaattgattgaacacttggagaatgtctatttcaaatttaaacatgtccatgatcaaaaatgtccttaagtggtccagaaagtgcaatacaattgtgggaaagaaactccttgggaaagtgaaattgtggtttgccttgtatcaaaactcctatcaaaacttttgaaactcttttgcaagatggtagaaaatagcctaaaagtttaaaagtgatacacagggaaaggtccataaagctgtggtcaagaacatccctgaatatctccacaatatagtgatttccttggaactatccactttgctcaaatagccatgagaaattccagttggctgcctcatccccattgttgttctgcctcttttgattagcagcattagagatccactttattcttgttcccatatgaatagtttattttctctgtttaatgttaaggaaaagtataccctattcttgaagctctttaaatgcctctctaaaatttgaccttgattttaaaatagtataattttctttggttgtcagtgctgctttcagtggctcagtttattaggagccatacatttaaaacaacattcactgaccttttaaaaaatgggaaacaagccaatgctattctaatggaaaccccttgtgggttctgtggttttatgtaagtgatgtaagcttagctaatatagaattagtgagttccaaaacttgactaaatgctttccctgtcactacttttatgagaatgagatcatattttctgctgtttcttatatgggggtgggtgaagaagagggtgttgaattatatgttattgcttctttcaccattgtaattctaaaatttcatggggtagactttttgaaatgaaaagcagagagaaaaaattatgaaatattatccttgatgcaatggtgattttgttcaaattcttgttttaaaaattgagggcccaattaagttagggaatacaactatctttctctttttagttaacttacataatttgagttctgactttctacttctatatgtgattttattagaattaaagataggctggtcctgaatgcctataaaatgtaagtgctgcagaggaccctgtttcacatggtatagtggttggtgaacagcatttcaccaaccactatcgctagctacccttggaaattttattcttctaaccaagtacctaatgaaagtaattcaggagataaaggggatgccttgcttaccttcaaaatggagatcctcaaatttcagcaacattcacctctcatctctcttgttgagaggccagaaggacaggatcataaagtcagagagctggaacttctgtgtttttagtcttgcagtaaaagtggagttaaaatgatttcaaaatcagggccaatatttttgagaaagtaaactttaaaaaattaaaaatattataaagagagtctgattgaaatcaaatgtggctcttgtacagactgtttaagcattgattttcatttagatgatttctctctcccttacatctccaagtaatctctatggagttcggggtttttgtccctttcactgatgtattccaagcttataacagtgcttggcacagagtaggcacccaataaataattacagaaaggatgggtagatggatagattgatgggtgggtagatatggattttacataacaaacatgattgctttgctcctctgaaaaatcaaaactaatttgtcacaattaataataaagttgttttaaggcagtggatttcaaccagggaagatttagccctccctccatgtcccagggatatttgacaatgtctggagatatttttggttgtgaaaactgaggagtgatactgctggcatctagtgagtagaagccagaaatcctgctaaatgttctgtaatgcataggacagtccccccataacaaagtattacctggcccaaaatgtccatgttgagattgagaaactagtttacattcctaccaagttgatttaagggattgactatttctttgtgttctccaggctttaatcctaataaaatatatctttatcaagtagattttagagtctataagaatcagcaatatgcctgttaaaatgttgatccctgggccccatgctcatatattgtaaattattgctaataatgctttggctttaaagtttatttttttctcatatgaatatagctatattatatataaacatataatatatattatatataaacatatattatatataaacatattatatattatatatattttgattcacgtttacatgatatatctattttcactgcctactttcaacctttttatatccttatattttagatgtatcttttataagtaccatataatacttcatttaaaaaaatccatctgactattctttttttctctttgtttgagacgaggtctcactattttgcccaggctggtcttgaactcctgagcttaagctatcttcccacttcagcctcctgagtagttgggactgcaggcatgtgccactttgcccagcctgctgtgtatatttaatttgttctacttgttctgtactccttttctgttttttcttttgaaataattggatacttcttaatgacacattttaaaaaatcttacgaagttttatatcattttactattcctattttaaaatttattttattttaggttctggggtacatgtgcagaatgtgcaggtttgttacataggtaaacctgtgccatggtggtttgctgtacctatcaacccatcacctaggtattaaaacctgcctgcattagctatttgttctgattttctccccacctggcccccccaacaggccttggtgtgtattgttcccttccctgtgtccatgtattctcattgttcagctcccacatatgagtgagaacatgcggtgtttggttttctgttcctgggttaatttgctgagtatgatggcttccagcttcatccatgtccctgcaaaggacatgatctcatgcctttttatggctgcatactattccatggtgtatgtgtaccaattttttttattatactttaagttttagggtacatgtacacaacgtgcaggttagttacatatgtatacatgtgccatgttggtgtgctgcacccattaacttgtcatttaacattaggtatatctcctaatgctatacctccccgctccccccaccccacatcaggccccagtgtgtgatgttccccttcctgtgtccatgtgttctcattgttcaattcccacctatgagtaagaacatgcagtgtttggttttttgtccttgtgatagtctgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctatcgtgaatagtgccgcaataaacatacatgtgcatgtgtctttatagcagcatgatttataatcctttgggtatataaccagtaatgggatggctgggtcaaatggtatttctagttctagatccctgacgaatcaccacactgacttccacaagggttgaactagtttacagtcccaccaacagtgtaaaagcgttcctatttctccacatcctctccagcacctgttgtttcctgactttttaatgattgccattctaactggtgtgagatgttatctcattgtggttttgatttgcatttctctgatggtcagtgatgatgagcattttttcatgtgtcttttggcggcataaatgtcttcttttgagaaatgtctgttcatatcgttcacccactttttgatggggttgtttgtttttttcttgtaaatttgtttgagttctttgtagattctggatattagccctttgtcaaatgagtagattgcaaaaattttctcccattttgtaggttgcctgttcactctgatggtactttgttttgctgtgcagaagctctttagtttaattagatcccatttgtcaattttggcttttgttgccattgcttttggtgttttagacatggagtccttgcccatgcccatgtcctgaatggtattgcctaggttttcttctagggtttttatggttttaggtctaacatttaagtctttaatccattcttgaattaatttttgtataaggtgtaaggaagggatccagtttcagctttctacatatggctagccagttttcccagcaccatttattaaatagggaatcctttctccatttcttgtttttgtcaggtttgtcaaagatcaggtggttgtacatatgcggcattatttctgagggctctgttctgttccattggtctatatctctgttttggtaccagtaccatgctgttttggttactgtagccttgtagtatagtttgaagtcaggtagcgtgatgcctccagctttgttcttttggttttggatcgacttggcactgtgggctcttttttggttccatatgaactttaaagtagttttttccaattctgtgaagaaagtcattgttagcttgatggggatggcattgaatctataaattaccttgggcagtatggccattttcatgatattgattcttcctacccatgagcatggaatgttcttccatttgtttgtatcctcttttacttcattgagcagtggtttgtagttctccttgaagaggtccttcacgtcccttgtaagttggattcctaggtattttattctctttgaagcagttgtcaatgggagttcactcatgatttggctctctgtttgtctattattggtgtataagaatgctgtgatgtttgcacattgattttgtatcctgagactttgctgaagttgcctatcagcttaaggagattttgggctgagacaatggggttttctagatatataatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccaattttcaaatggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtcattggttctgtttatgtgctggattacgtttattgatttgcgtatattgaaccagccttgcatcccagagatgaagcccatttgatcatggtggataagctttttgatgtgctgctggattcagtttgccagtattttattgaggatttttgcgtcaatgttcatcagggatattggtctaaaattctctttttttgttgtgtctctgccaggctttggtatcaggataatgctggcctcataaaatgagttagggaggattctctctttttctactgattggaatagtttcagaaggaatggtaccagctcctctttgtacctctggtagaattcggctgtgaatccatctggtcctggattttttttggttggtaagctattaattattgcctcaatttcagagcctgttattggtctattcagagattcaacttcttcctggtttagtcttgggagagtgtatgtgtcgaggaatttatccatttcttctagactttctagtttgtttgcatagaggtgtttatagtattctctgatggtagtttgtatttctgtgggatcgttggtgatatcctctttatcattttttattgtgtctgtttcattcttctctctttttttctttattagtcttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgtgagggtgtcaattttggatctttcctgctttgtcttgtgggcatttagtgctataaatttccctctacacagtgctttgcatgtgtcccagagattctggtatgttgtgtctttgttctcggtggtttcaaagaacatctttatttctgccttcgtttcattatgtacccagtagtcattcaggagcaggttgttccgtttccatgtagttgagtggttttgagtgagtttcttaatcctgagttctagtttgattgcactgtggtctgagggacagtttgttataatttctgttcttttacatttgctgaggagtgctttacttccaactatgtatgtaccacatttttttaatccagtctgtcattgatgggcatttgggtttgttccaagtctttgctattgtgaatagtgctgcagtaagcatatgtgtacatgtatctttataatagaatgatttatatccctttgggtattatacccagtaatgggattgctgggtcaaatggtatttctggttctagatcattgaggaatcaccacactgtcttccacagtggttgaactaatttacattcccaccaacagtgtaaaagtgttcttatttctctgcagccttgccaggatctgttgtttcttgactttttaataattgccattctgacttttgtgggatggtatctcattgtggttttaatttgcatttctctaatgatcagtgatgttgagctttttttttcatatgtttcttggccgcataaatgtcttcttttgagaagtgtgttcgtgtcctttgcccactttttgatgtttatttttcttgcaaatttgtttaagttccttgtaaattctgaatattagacctttgtcagatgggtagtttgcaaaaattttctcctattctgtaggttgcctgttcgctctggtgatagtttcttttgctgtgcatacactctttaattagatcccatttgtctatttttgcttttgttgccattgcttttggtgatttcatcataatatctttgcgcatgcctattttctgagtagtattgcctgcgttttcttctagggtttttatggtttttggttttatatttaagtcttcaatcttgagttaatttttgcataaggtgtaaggaaggggtgcagtttcagttttccacatatggctagccagttttcctagcaccatttattaaatagggaatactttccccattgcttgttttgtcaggtttgttgaagatcagatggttgtagatttgaggtcttatttctgagatgtctattctgttcccttggtctaagtgtctgttttgttaccagtaccatgctgttttggttactgtagccttgtagtatagtttgaagtcaggtagcatgatgcctacagttttgttctttttgcttaggattgtcttggctgttagagttcttttttgtttccatacaaattttaaagtagttttctctaattctgtgaagaatgtcaatggtaatttgatgggtatagcattgaatctataaattactttggacattatggccattttcacaatattgattcttcctatccacaagaatgtagtgtttttccatttgtttgttttctctcttatttccttgagcagtggtttgtgagtgtacacaataaccagctagcatcatgatgacattatcaaattcacacataacaatatttaccttaaaagtaaatgggctaaataccccaattaaaagacacagactgacaaattggataaagtgtcaagacccatcagtgtgctgtattcaagagacccatctcatgtgccaagatacacataggctcaaaataaagggatggaagaaaatttaccaagcaaatggcaagcagataaaagcagaggttgcaattgtagtttctaacaaacagactttaaaccaacaaaaatcaaaaaagaaaagggcagtatataatggtaaagggatcaacaagaagagctaactatcctaaatatatatgcacccaatacaggaggacccagatttgtaacgcaagttcttagagaactacaaggagacttagactcccacacaataatagtaggagactttaacgccccactgtcaatattagatcattgagacagaaaattaacaaggatattcaggacttgaactcaactctggatcaagtggacctgatagatatctacaaaactttccacccccaaacaacagaatatacagtcttctcagtgccacgtggtacttactctaaaattgatgaaataattggaagtaaagcactcctcagcaaattgcaaaacaactgaaataataacaaacagtctctcagaccgctgtgcaatcaaattagaactcaagattaagaaacttactcaaaaccacacaactacatggaaattgaacaacctgctcctgaatgactcctgagtaaataatgaaattaaggcagaaatcaaaatgttctttggaaacagtgagaacaaagagacaatgtaccagaatctctgggatgcagctaaagcagtgataagagggaaattatagtactaaatgcccacataagaaagctagaaagatctcaaattgacaccctaacatcacaactaaaagaactagagaagcaagagcaaacaaatccaaaagctaggagaagacaggaaataactaagatcagagcagaactgaaggagatagagacatgaaaaatccttcaaaaaaaatcaatgaatccaggagctggttttttgaaaaaattaataaaatagatagactgctagctacactaataaagaagaaaagggagaagaatcaaataggctcaatgaaaactacaaagggcatatcaccactgaccccaaagaaatagaaacaaccatcagagaatactataaatacctctttgcaaataaactagaaaatctagaagaaatggatcaattcctggacacatacaccctcccaagactaaaccaggaagaagtcaaattcttgaatagaccaataacaagttctgaaattgaggcaggaataaataacctaccaaccaaagaaaaaaaaaagcccaggatcagatggattcacagctgaatgctaccagaagtacaaagaggagttggtaccattccccattccttctgaaactattccaaataattcaaaaggagacactcctccctaactcattttgtgaggccagcatcattctgataccaaagcctggcagacacacaacaaaaaaaacttcaggccaatatctctgatgagtattgatgcaaaaatccccaataaaatactggcaaactgaattcaacagcacatcacaaagtttatccaccatggtcaagtggtcttcattcatgggatgcaaggctggttcaacatatgcaaatcaataaatataattcatcatataaatagaaccaaggacaaaaaccccatgattatctcaatagatgcagacagtcttcgataaaattcaacatcccttcatgttaaaaactctcaataaactaggtattaatggaacatatctcaaaataataagaactatttatgacaaacccacagccaatatcacatggaatggggaaaagctggaagcatttcctttggaaactggcacaagacaatcatgcattctctcaccactcgtattcaatgtagtattggaaattctggccaggtcaatcaggtaagagaaagaaataaagggttttcaaatatgaaaaaggaaatcaaattgtctctgtttgcagatgacacgatcctatatccagaaaaccccgtcgtctcaacccaagagatccttaagctgataagcaacttcagcaaagtctcaggatagaaaatcaatgtgcaaaaagttacaagcattcctatacaccaacaggagacaagcagagagccaaatcatgaatgaacttccattcacaattgctacaaagagattaaaatatgtaggaatacagctaacaaaggatgtgaaggacctcttcaaggagaaccatttgtctattattttaactgactaccctaaaaattaaaaaaaattattgtgtgctttatgaaaagtatttatttgatacttattctctcctcttagacaatttaaaactttctattacatacctccatctttttaaaaaatttttaagcaacacataataattgtacatatttgtgggggtgcagagtgagatttttatacatatatacaatgagtaatgattgaatcagagtaattagcatatccattacctcaaatattcatcatttctttgtgctggaaacattcaacaacctatctatttgaaattcatctatttgaaaacatacaataaattactaactatagtcaccctacagtgctatagaatactagaacactagaacttatttctcctctctagctgtaattttgtatttgttaactaacgttttcctcacctcttccctactcttcccagcctctaataaccactattctactctctacttctatgaactcaacatttttatctcacacatgagtgataacatgcggtatttatctttctgtgcctgacttattttacttaatataatgtcctccaggttcatccatattgcctcgaatgacaggatttcattctttttatgactaaataatattctttttgtgaatatgtatgtgtgtgtatatatatatatacacaacatatatatatacaacatatatatatacaacatatatatatacacacaccatatatatatatgaaacattttccttattccttaatcttttgctggatacttaggttgactacatattgtactactgtaaacatgggggtgcagatgtttctttgatatactgatttcctttggaaatagtagtggtagtgctagatcatatggtagttctattcatagatttttgaggaaacttcatactgtttttcataatggatgtactaatttatgttcccatttacagtgtatgagttttctttgtgttctcaccagcatttatttatttttatttgtttctatttgttacaacaaattcaaacttttggacaagagccattccaactgggatgagatatgtcttactgtggtttagatttgcattttcctggatgattagtgatgttggacctgtttttcagatacttgttggccatttgtgtgtcttcatttgagaaatgtctattcagatccttcaccaatttttaaatcaaattatttggggtttccttttgctcttgagttgggttcttttttattctgtatattaatcacttgtaggatgaatggcttggaaatgttttctgcctttctacaagttatctcttcactcagttgattgtttcctttaatatgcagaaacttttaagtttgatataatcatgtctatttttgcttttgttgtccgtggtttggagtattttttaattctctttttaaaaaaaatattctttctattttgattttgagtcttacccacaaaatctttgcccacactaattcctgaagtgtttcccttatgttttcttgtagcaattctatagtttcaggtcttacatttaagtctttaattcatcttgagttgatttttgtttatggtgggagatatgagtctagtttcaatcttctgtgtatggatattcaattttcccagcaccgttttttgaagaggctctcctttcagtgtatgttcctggcacctttgtcaaaaatcagttgactgtaaatatatggatttatttctgggttctctattctgttccattggtctaagtgtcttttttaaaccagttctatgctgttttggttactatagctttgtggtatattttgaagtcaggtagtttgatgactctaggtttgttctttttgctcagaattgctttggttcttgggggtcttctgtggttccatataaattttagaattgctttctctgtttctgtgaagagtgtcattggtattttgatagggattgcttcgaatctgtagattgctttgtgtaatataatcactttaacattatgaattctgacattagaaagcacacttcacctctctaatgtgacctttctcacaggtgtgcctccttcagcttcccatgtggcacccacagaaacattcacctatgaatggactgtccccaaagaagtaggacccactaatgcagatcctgtatgtctagctaagatgtattattctgctgtggatcccactaaagatatattcactgggcttattgggccaatgaaaatatgcaagaaaggaagtttacatgcaaattggagacagaaagatgtagacaaggagttctatttgtttcctatagtatttaatgagaatgagggtttactcctggaagataatatcagaatgtttacaactgcacctgatcaggtggataaggcagatgaagactttcaggaatctaataaaatgcactggacttttaatgttgaatgccttacagctagctgatcattacacaggcggcatgaagcaaaaatatactgtgaaccaatgcaggtggcagtctgaggattccaccttctacctgggagagaggacatactatatcgcagcagtggaagtggaatgggattattccccacaaagggagtgggaaaaggagctgcatcatttacaagagcagaatgtttcaaatgcatttttagataagggagagttttacataggctcaaagtacaagaaagttgtgtatcggcagtatactgattgcacgttccgtattccagtggagagaaaagctgaagaagaacatctgggaattctaggtctacaacttcatgcagatgttggagacaaagtcaaaattatctttaaaaacatgaccacaaggccctactcaatacatgcccatggggtacaaacggagagttctacatttattccagcattaccaggtgaaactctcacttacctatggaaaatcccagaaagatctggagctggaacagaggattctgcttgtattccatgggcttactattcaactgtggatcaagttaaggatctctacagtggattaattggccccctgattgtttgtcgaagacattacttgaaagtattcaatcccagaaagaaactggaatttacccttctgtttctagtttttgatgagaatgaatcttggtatttagatgacaacatcaaaacaaactctgatcaccccaagaaagtaaacaaagatgatgaggaattcatagaaagcaataaaatgcatgctgttaatggaagaatgtttggaaacccacaaggcctcacaatgcacatgggagatgaagccaatgggcgatgaaatagacttacacactgtacattttcacggccatagcttctaatacaagcacaggggtgtttatagttctgatgtctttgacattttccctggaacataccaaaccctagaaatgtttccaagaacacctggaatttggttactccactgccatgtgactgaccacattcatgctggaatggaaaccacttacattgttctacaaaatgaagacaccaagtctggctgaatgaaatacattggtgataagtggaaaaaagagaaaaaccaatgattcataacaatgtatgtgaaagtgtaaaatagaatgttactttggaatgactataaacattgaaagaagactggaaacatacaactttgtgcatttgtgggggaaaactattaattttttgcaaatggaaacatcaacagactatataatgatacatgactgacacttgtacactaggtaataaaattgattcctacagtctaatcatatcaccactattagggttttataaaactgcatttaaaaaaagatctatgaccagatattctcctgtgtgctcctcaaaggaacactattaaggttcattgaaatgttttcaatcattgccttcccattgatccttctaacatgctgttgacatcacacctaatattcagagggaatgggcaaggtatgagggaaggaaataaaacataaaataaataaaatagaatgacacaaatctgagttttgtgaacccctgaagggatggtctaaaggacgttatctggaactggagaaaagcagagttgagatacaattctatagattaaatcctggtaaggataaacattgccattagaagaaaagcttcaaaatagacctgtggcagatgtcacataagtagaatttctgccaagccttaactgcattcagaggataatatcaatgaactaaacttgaactaaaaattttttaaacaaaaagttataaatgaagacacatggttgtgaatacaatgacatatttctttattttcacatacactctagctgaaagagcaagagtacacatcaacaaaaaaatgggaacaaggctttggctgaaaaaaacatgcatttgacaaatcatgttaatagctagacaagaagaaagttagctttgtaaactacttcatttgattcagagaaatagagcatgagttttcttaaagtaaaaagaaaaggaacaaagaaaatgaggtttgaaattttttaccatggcaaaatattaacatctttctcaaaaacatagagaaatctggaaaaatcaagaagataaaattctggaccagttagtgacattctttcaagcatacttgtaaaatgtttccttagagtgttcttgggatgaaaatgattgtcatgtctccaacaacagtgaactgatgttgttccttggaataaaagtcaatccccaccttaaaaaaaacaaaacaacaacaacaacaacaaaaatatgaattcttccaatccatgaacatgagatgtctttccatttttgtgtttgccctctttaatttcttttagcagtattttgtaggtatcattgtggaaatctttcacctttttggataaatttatttttagctttaaaaatcttttgtagctactgtaaatgggataattttttcttgatgaattatttattactggtttatagaatcactactgatttttgtttggttgattttgtatcctgcaactttattgaatttgttaattagttcaaacaggttttttggcggaatctttagttttttgtttttttttttaaatatataagataatgtcatctgcaaatagggacaatttgacttcttgtttcttaatttcattccttactatttctttgtcttgcctaattactctcttaggaactccagtactgacatggtttggctctgtgtccccacccaaatctcatgttgaattgtaatctccaatgttgggggagggacctggtgggaggtgattggattatgggtgcagatttaccccctactgttcttgtgatagtgagttcttatgagatctggttgtttaaaaatgcacagcacttcccccttctctctcctgctgaccatgtgaagatgtgccttgcttcccctttatcttcttccatgattgtaagtttactgaggcctctccagccatgcctcatgtacagcctgtggaaccatgagtcaattaaacctcttttcttcataaactacccagtctcaggcagttctttatagcagtgtgagaatggagtaatacaagtattatactatgttgaataagagtggtaaaaaataggcatccttgtcttgctccagatttcagaggaaaagcatttttcttttccctgctgaaagcttttccatactcactatgattttactgtgggtttatcacatacggcctttactttgtttagtcatattcctttaatacctaatttgttgagagtttttatcatgacaaggtgtagaattttatcaaatccgttttctgcctctattgggatgatcatatgatttctacccttcattctgttgatatgatgtattatatatttacttattagcatatattgaaccatccttgaatccatggcctaaatccacttgatcatggtgtgtaatcattttgatatactgttggattccatttgctactatttttttaaggtttttgcatctgtgttcatcaaggttattcatttgtagtttttcttgttgttgttgtgtccttttgtggttttggtataagggaaatgctggccttgaagaatgagttaggaagaatttccttctttcttttcggaatggtttgagaaaagtggatgttagtttcttaaaagtttgatagaatttagcagtgaagttatgcagtcctgggcttttttgtttgtttattttgggagacttattactgtttcaatctcattactcattactgatctgtttaggttttctatttcttcctggttcaaccttgttaaattatatgtgtgcagaaatttatctgttttctctaggttttccaattttttggcatatagttgttcataataatctctaatgatcctttgcgttctgtgatattaatgtgtctcctttttcatttctaattttatgtattggaatcttctgtctctttttagtctaatgccatgttgattttgtttatcttttcaaacaactttttaaatttgctttttattctctattttgtttatttctgcgctaattttctttctttctttctactaattttgggtttaatttgttcttgcttttctagatccttgaggtgcattgtcagattgtttatttaaaatctttctaatttttgttgtaggtgttcattgctataaacttccctcttagtaatgcttttactatatttaataggttttggtatgcagtgtttctgttttcatttgtttcaagaaacttaaaagttttcttcttaatttctttattcacctttggtgactcaggagcacattgttacacttttatgtgtttgtacagtttccacagttcctcttgttattgattcatagttttattccattgtgatctgaaagatacttatgattttgatttttaaaaatttgttgagacttgttttatgtcctaacatatggtttatcctggagaatgttccatgtgctggaaagaagaatgtgtattctgcagctgttggatgacatgttttataaatgtctgttaggtccatttgattttgtagtgcagtttaagtctgatgtttcttcattgattttctgtctggatactctgtccagtgctgagagtggagcgttgagtccccaactattattgtactagggtctatctctccctttagttctactgatacttgctttatatatctggctgttccagtgttgggtgcatatacatttacatatgttatatcctcttactgaattaatccctttatcattatataatgaccttctttgttcctttttatattttttgacttgaagtctgtttcatctaatgtaagtatagttactcctgctcacttttgttttccatttgtatggaacatcttttcccatcccttaactttcagtctatgtgtgttgttgcaggtaagtgagttttttgtaggcagaatatagttgggtcttatgtttttatccattcagcctgtttaaatcttatagttgggaaaatttaaactgtttatattcaatattgttattgatggtgagtacttacttatctttttgcctccctccacctctgctttccattcttttgtctccctgtgtttagttctagatatgttctcctgatatattttacaaattaatactttttttttcagctttgtctacatgttgtcaaacctacccattagattatgtatttcagttttatttattgttacaatttcttgttggttctttttcaaatctactatgttactttttacacttttcatttatctcctgaaaatcttaaacttggcttttattttccagatcatgttaagtgtagttatttctatcttatattcccatggttgtcttttttgtattatatagatctcagctcagatatcaactcctcaggagagcttttcctcacaactcagtcaaagtagcctctactctatgacatcaaattttaaatttttctttatggcacttaccactgtaataaatacatgtttagatttgtttacttgcttattgtttttatgtacccaccctccatttttttagcctccatagaatgcaaatttccatgaaaacagcatctttgcctgtttattcattgctgtattttattgccaagagcagtccttggcaaataataagcatacataataagcaacaatacacattgttgaatgaatgaatgactgaatagctttatcatagcctttgtctgatttccctacacttcatctaatgttcacaagtcacaaactttgggagggtctcaaaaatcttctctgaccttgatgtcagaacttgtctccatcttgatcctacttctctcaacttccactttatttgcttgcttttatattgctttcctgttccacttatttttcagaagactttgtgttctttcttctaagaccactttaaggtaaatctctttaatagctgcattacatttctattatagttatatttccttttaaattttatcaggtagttaaaattatataaacccctaaaaattcttactgctatggctgccaagtttagaaaaaaattaaaagattatagttttaaaatcaatatttttttctatattttgagctctaattttattggccacacttttcatatcttctattataaattacaaagttcttagaggataatggaatatatattaaaatacaagccaaatcaaaaataaaaattcagctcttgactgagaaggtatctcaagagacttccaaagctccctatataaaatttcagggaatttcagaatattttatttgttgtcaggagtgagagtatgaggcaaggcaatcaattttttcattattcttaagatttttatgaagtgggatcaaataaatttatagaaaagttcctacaactttataaatgttagctttctcttgttttttctccaagtgcccatatacagaaaatcacattgtaaattgggattgtggagaaggtattgtgagataggtatagtgattagaggcagtaaatatggaaggttctagaatataatgagggttaaaaactaacttctctgtcaagaagacaactacccaaaggtgtcaggaaactaggctcagaaaatagctcattcttttgttagagccaggactgctttcctttaggaaaagctggcaaggaaattccatggcctagaagtctgaagattaaggtcagaaccttcaaagatggccaaagtccatcgtagaaggctactcttcagtctggggtatactcagaatggttagctatggtttcatctatctaggtcacagatgctttctggaaacagtaatatgccaagaaaggatatgtaaagttgctatataaaaacaaacaatggttaataatattttttgaaaactatgctggttttgtgctaaacactttaaatagtatccttttatttaattttcattatagtttcatgagctaggaactattaccatttccattttacagatgataaaactgaggctttcagaaaagattaaggtacttttctcaatttcagagctgaaactcaaacctaggttgcttcaaaaccaaaaatactcttaattactagtagtgatttatataaacatattatgcctgattatcatgtattgttcttgactgttcgttaatattgcatgttcttttaattgttgaggaagacttgactgagttgaactagccagagaagggactgatctgtgaattccttccttgctgctacatacctccctaactcctataggctcactttagaaaatagaagtcaagactcctacgaaggttcatttgagatgggaaggttggtgaatagacattttgtgcctggtaattaggaggaacaattggcaacatctgtagttcccccacaaaaggaaaattttgcctaatttttgagaggaagaaaggatattctctggcaccatatcttagagtctttgctggcattcctgtagtccaggataaaatgggaatgtcaaagaaatttcaggtgcggttttataggagggtacattaaagaaaaagcagagctgaaagtcaaggaaataattccaaacagaaggcactgggttagtaaaagacttaggcaacttagctgtgcaggggatgccatgcaactgaatcacaaagggtgacacactaggtgaccctcagaaaagctgatcgtgtcactgtggggagaccatgaggtttttgttactgtagttgcttgtttcagaatgcaaaagttttgcttcctttctctttcttatacttgtaagaagggagttagtgctaatatattaaaataatctggtggcaagatttctcaggtggtttggtgcgtatttggacctcagatttttttctatgtgcatctctgtcatgagaattatagctgattcaagtcacatgtacaactctaataaagacatgcagttaatgggttttctgtttttgtgtagtagatatattttaatttttttcattaatggaagaagtatgatgggtgaaaacatcagacagagtctggaatcagacaaacttgggttttaattctgacaatacttatggttgacgttttatgattcctgcagataacagctattgcaagagatccctgagttggctgtagaagaatgcaggtttttcttggtatatttctttacaaattagctttcccagggaaatctagtgagcaagattttggtagtaacctcttttttaggtcataatagagtgaagggcagccagagtgctgacttggttggggcagcattgtgtagtagaaaacacatgaactttcatgcactgcatatgaattccagttttgcaactttctaactgtgtgacttcgggaaaattttaattgaacttgaactttaattcctttatctaaaaaatgggataataatacaaatgatactgtctaccatgaggattgactgagctaacaaatataaatcaccaggaacatagcaagtactttgaatattacattagttctaattcctgtcttcccttgtcaccatcaaagctccagcatgttcctccacctcatacacactattacagtagtgtaggactgccaccataatgtcagaaccttagacaaattgtgctagaaggtggtattattgctttcttgccactcatttttccttaggctaccctacatatatgggagtcctctggggcaatctaacctggacaatgagagaacagatgggaagagggggttgtaaaataaactgaaaaaaaaaaaaaaaaaaaaaaaacctatgaatacctgaaaatcctaatattagcaattttgaaaaactttatggcaggaagaggaattataatttatattccttgatcaaagatatgctctgtaaagcaagaagaaaacaaaatcaaacatatagcttgtgttaaatattagcgtggaaaagggcactttacgaaattgttttatgggatacatatacaattgttactcaattattcactattttagagtgcaagttccactgaaagtgccctggggaatggcaagtagagtcagtccagtactacccgtcctcatataaaaagaacaagatttatgcctccacagaggaagctcaagactgccaaccaaacgctgttatttaacaaaggttctgcccctggtcgttttcagacacagagctggttatagattctgttgttcttttccccacctacactccggtgcctttgcccactttgctggatagtcacagtttttagttacagtttttgccccactccctgttgggctgtgatacttcttcaaagattcagagatttggagggtaaagaaagcaagaggagggcaccatgctgaaaactcagtgagtactacaggagcagcaaaataaggactgcttctagggaaggctgtagtagtctgttgttatgctgttaataaagacatacccgagactgggtaattataaaggaaagaagtttaattgcttcacagttccatatggttggggaggcctcacaatcatggcggaaggaagtaggaacaagtcatattttatatggctgcagggaagggagaacttgtgcaggggtactcctttttataaaaccatcagatctagtgagacttattcactatcacgagaacagcccgggaaagacccgcccctatgattcaatatccttccactggctccctccgacaacacatggaaattgtgggagctacaattcaagattggatttgtatggagacacagccaaaccatatcaaggggagaaactggaaagctcaacggaatgctttcagcactaatatatacaaggaagtgagatgtgaaacatccagtgttttgctagtaaatgtttaacacaatcagctccctggggcgccagagcggaaccctcgtttgtagcatctgctaattcccataatgtaaatactcccaccatggcctgtttcaagctaccaatataatgtcactaaaagccatgttggacattgatgctcagaactggctcttctgtgttggtgccagtcagcacaccagtgatagtagccttagcaccactgactgagacagggaggatatggtagagaattttaagagacgatgttccctttttggtgatagaaattcttaaaatattagctttactgctttattaactgtatgactttctgtagagatccttaaattccccaagtctcaatttccttatttattaatatatgtattcgatatacattttctgagtgtcttttgtatgccaggaacttttgtagacatctggatacagaggtgaataatacaaattccctgccctcttggagcttataatctagtagggaagactgataatacacaggtaaacaaatttaaggtagtgtcatgaagaaaacgcttagggcattgtaagcccaggaggggaaattttgtctgttttgggcactgctgtgtcctcagtgcttacgacattgtaagaatgattcagagtataaatgaaggctctggtactctaattagggcttttggaaaagactgaggggccgaaagatgaccagaaatatgtgattgatatacaagaacaaatgtggcaggtgctgttgggtagctgctgacacccccatctccagccctcctctcctgaactacttccagtgggagtggtcatgtgtcacagttctggctagggaaaaataaatggaaatcttttgggtgggatttccaggaaagcttttgtttttcctataaattggacagactttatctcttgccccttggtcttttcttgtttgtgttgcctgaatttgattgagaattagcagccatttgggactgtaaagtgcaagcacgaagacaacaacctacctgctaagcaggatggacctctggcagcagcattgcacagccttactactcctggcctgctcaacttgtgacacttgttacatgagataaatgacactctatgtgttgtctgtttttttgtgttttgtgtttttttttgcaattaatatagcaagccaggccataaaaatatagaaagaataatgaatactaaataagtcatataaaacagtagaatttaagaaacattgctcaaaaaatgttgctcttaatatcataatgactcaagtaataaagaatcattacatacttttgagcccttattctgtgctttataataggaatcataataatgtgagtgattccagagtcaaatacaaaaaacaaactgaatttaaaatcttgggactaacgttaatagctgtcagttgacacttcatcaacaattcagacacttatatttcaaaacaggaagcaacaaaatgcttggaaaaagatccaggactttataaaatattgtcctttttagagctggaggccataatcctaagcaaactaacccaggaacagaaaactaaatactgcatgttcttacttataagtaggagctaaacactgaatacacatggaccaaaatagggaacaacagacacagcggcctatttgagggtagaaagtgggaggagggagaggattaaaaaactctctatcaagtactatgattattacctgggtgatgaaataatctgtataccaacctccatgaaatacaatttacctatataacaaacctgcacatgtacccttgaacctaaaataaaagttaaatttagaaaatattatctttttggtatagaaatttcaatatagaagcaaattactgaagagtttcctgacacaaaggagcatgagtacatgtacatatgtgtgtatataattttttttttattataccttaagttttagggtacatgtgcacattgtgcagcttagttacatatgtatacatgtgccatgctggtgcgctgcacccactaactcatcatctagcattaggtatatctcccaatgctatcccctccccccctacccccaccccacaacagtccccagagtgtgatattccccttcctgtgtccatgtgatctcattgttcaattcccacctatgagtgagaacatgcagtgtttggttttttgttcttgcgatagtttactgaaaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaataaacatacgtgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttgctgcataaatggccatactgcccaaggtaatttacagattcaatgccatccccatcaagctaccaatgcctttcttcacagaattggaaaaaactactttaaagttcatatggaaccaaaaaagagcccacatcgccaagccaatcctaagccaaaagaacaaagctggaggcatcacactacctgacttcaaactatactacaaggctacagtaaccaaacagcatggtactggtaccaaaacagagatatagtcaatggaacagaacagagccctcagaaataacgccgcgtatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgtatataatttttttaaaatagtcaattctgaggctctaaggaatgtaacaaaaacagaatgtatgaaaaaaagaatttgggttttatgttcctaaggctgaatcgtgtttctcaaccatttttacattattgtttcccttcacccaggacaattgtttgactttattcctctaataacctcctcttaccccccatgaaattttagtattagttattccatgtatacatttatattgtcagagttgagcttcggaggatcataaacaattataatatctaagattttttcacctcccccataaaccgatttttacgtccttggggatgatatcaccccctcctgctccctgattaaaatgcgtaagctgaaccagcactgaacttgaaaaaatatttcttacttttttacctcatgggccagatatgtgggagagttttcaaacttctgagaaaatcttagaatcagcacagatgttgatacagctttcttgaaagtcttgaaatatttttagccctgggaagatcatatccacgttgggaagctgtgttttcagtcttttgagcaagtataggaggaatctatctcctagtattctcattcccaaatgtgtctttggaaaatttacacattggtaatcagaatcagagtgatgtaaatttaatgattcctggaaaaacttttaaaaatgtcttttcactgtagattatttggaaaatatagataagcaaacaataaaagccaaattacccatggtctgaccaaggaggtgtgaacaacatattggcttatttctttactatttttccattttaaaaatgtgtatgtgagtgtgagggcatgtatccacatgcacatggaggttttttttttaaaaaatggaatattcagacatgttaatgtgtttgtattattagtattatcatacatattaatgtattattcatacatgctttgtaatgtatcttttacattttattgtaaacatttccccatggtttagagtattttcctacatcactatttctactggctatttagccttgatatatgtatataattaaacagtcccctattttttgacaggtaggattcttcacacttcttaccacaataaaaatgcttctataaagttcagtgtggctactctttgtacataccattagttattcccttaggaaatatatctagaagtgtaaatgctatctcaaaaattatgcacacttctactgatttgataaatattgttaaattatgcttcaggaaacttctatgagtcaacatttccaagttttctaattggttattatcacttctttttcttgctttatgtaagcaattctttacatatttctttgaagatagtaattatactaattattttatagtcctgttttatcagctctatttcctctggtataaactctttatttatttttattttttgagactgagtttcactcttgttgcccaggctagagtgcaatggcaagatctcagctcaccgcaacctccacctcctgggttcaagcaattatcctgcctcagcctcccgagtagctgggactacagtcatgcaccaccacactcggctaattttgtatttttagtagagacagcgtttctccatgttgctcaggctggtctcgaattcctgacctcgtgatcagcccgcctcagcctcccaaagtgctggaattacaggcatgagccactgttcctggccataaactctttcatctattagcctgaatggtgttggcattcagtgattatcagctccttgaataattttttaaatttcagcttatttttgaattctgggcacaggagattccctgaaagacttatgactgttttttcagttcactttacagagaggaaaaatgtctgacaggagattgctttggtcagtgagtgtgtggaagcaagtataatgcattctgattcttctctggtgttgccagctactcacggctccattttatttctctctgttcaaagcacatctcctaactaggctatagttgcgtaggatgtaggggaagagggtgagggataggaggaatagtgtggctatggggtagagtaggtagtctagtccacagagctgcttggtcctgagagagtatagtaatccctctgtctattgttccctgatcccattattctctgaaggactctactacctctgtgttttgaattgccttaattatttttggtaaaagctcttccttgggcttccatattcatcctgggtcaatgcttccttcctcatttgatactatctacatgtggtttctgttcctgtaagaatttatcttcctgtatttaagtggctatttatgtattattttaaaagttatcctcttatcatttctaagttttggcatgggaaggagggacactatgtatgcctatttttaccgtcttaaaactgaaagtacttgtatcaatttactaatacacttgcagtatattgtcaggtagagattaatggaagcaaagtaattgtcttaatccatctgggctgctataacaaaataccttagactgagtaatttataaacaacaggaattgtttataaatttgggatgttcaagatcaagatgccagcagatttggtgtctgttcggggcttgcactctgcttcaaagatagtaccttctagctatgtccttatgtggtagaagggtagacaagattccttgggaatcttttataagggctcaaccctcacaaactaatgatctcccgaaggccctacctcgatactatcatactggggattgtttcaacataacgaatttttgggggacacaaacattcagaccatagcaataatgaaaaaaaaagaagaaaaaacaaaagctgatcctaacaaggactttttattgaaagagagcaagaaacatgacttgcctactttagacaatgaactacatgttagtgtagtaccttatttttctacaatgccttgaagttatttaaacatccctcatttgatcttcacaattcaatgagatggatattattacttctatttataagatgagaaacaggctgaggtactctaaataatatgttcatagaggctgtgtggaagaaatgaattaaatcctttccccagcctgtaagtccagtgctttgtctagtctactattaagtacagataaagttatatgaaaagctaaaaaacagtattcttttggttaaaatagtgacttaaaggaaggtgaagaaaagcattcaagaaccccttaaaacatatagtctaatacagaagaacaaaaatatactaagtgaaattaaaggcgctatgcctttgagaggctttatttaaaaccacactgggccttgtatggaaaccaagccataagcttcaactgacattctttctgcagtctccatcatgaatctgaccactcaagttttaatttcctgtcagataagataaatggaagacaagatctcacaattaggtttcaaactataaacagccttcatgaaatctttgaatatatttcgtctagttcactgctatgagttgttgcttggtctgaatacattttaaaatggaattccttagtttaaattgtagactattccagggcagaagttgggagctttcacatctgtggtattccctaaggaaagtgccttttgtagagtctggttactgctcattccagcttttctttgtaactagtgctgcaaggtttacaagtatggttgaaagaacatcactaggtatacggctctcctatccagtggagaggtgctaactgtataactggcttttaaaacctgaaaagactgtttttaaggaataaatgactaaggattgggagtcttagattgagagaagagagaagtagagtttgacattttgcaaaggataattcactaaaaatacccatgaaggttatttggagcaatttagaaatattggagggacttatctatctgccaaaggtagagcaggagaattctatgacatgttgaaattgctgtgcatgttttcttttggttctttggttggaacataaatggagtttaattaaagttacacagggaggagtagggaaaatctcatggggactcaaacaggagatacggtaaggctgggcagagctcagaggtactggagttagcatgtgattctcagttcaaggaggagctggaatcctcagctgcatgaacatttaagtcatcatacctgttacacttaaatgcagcatatcttagccatgttccaaatgcttcttctgcttataccttttttctactcctttataacttcaacgtgcacatagcccactgtaaactctccagtccctgacataatacctgttctatttcagcttccagaactaaatgtcaaattatttccatatttcttggtttgaattcctgaagagtgtatgattaggccaacccttttgcggctaggtgattgaatcagagtttgtggccaggctatattggctttctttggctcaagagtcaagctcttgttcagttagttcagttcccaagcagtagaattatatggtgtaaaatctgcatatgacagggtctctgggtgggtggttgcacttcgaaaggggggcatcaacagagtaggaaacgtttggtggtcctattgtatgttgaatggtattcttgactaatttttaactatcttgaaaaggactaagttctgagtaagacgtgacaccaccggagttttttttttttgagcaggggagtgatataattggacatgctttaaaggactactttagatgctctctggagatgatcactattcacattttggcgtatttccttcttctccagtgtaacaatatttcttttactgaatcttttcttttctttcatgtatgattacttaacattttgtaggtatctctattacagaatttatttcatggcatcctctatttcagctgcaattgctgtcacatttccattgcctctttccttagtagtttctttggcttatggtttcaggcaccatccctcatatatatatatatatatattttttttttttcttttttttgagacagtctcactctgtcaccaggctggagtgcagtggtgcaatctcagttcactacaacctccgcctcctgggttcaagcgattcccctgcctcagcctcctgagtagctgggactacaggcatgtgccaccatgcccatttagttttttattttattttttgtattttagtagagatggggtttcaccatgttggccaggatgttctcaatctcctgaccttgtgatctgcctgcctaggcctcccaaagtgctggaattacaggcatgagccactgtgcccggcctctaggatatattttaaatagatgtattagggtctgccagagaaacagaaccaacaggatatctctctctctttctcaacatatttattataataaattggcttacatgattatgggtttgagcagtctcacttcactaactgctgtatacaagctgaaggcccaggaaagccagtggtatccttccagttcaatcatgaaggcctcagaagcaggagagctgatggcataagcctcagtcccagtacaggagaaaactgatgtcctagttcagtcagacagagtgaattctccctccctccacctttttgttctagtcatgccctcaacagattggataatgcccagtcacaatggggagggcaatctgcttcattcagttcatcaattgcttaatttcatctagaaacaccctcaaggcacaccaagaaataatgttaagccaaatatctggatacgccatggcccagtgaagttgacacataaaattaatcattacagtaaataagtttaaatatatttgaaatattattatatgttctgtttaatttatttactaatgtttagttaactgtgtggtcattttattaaaaataggtaattatagtcttttttggggggaggaatcagatctgaattactttatttgtaattacaatatcctttaatcaaggactgattgattagcacataaagaatgtacagtttagaaccatagatggcaattttaaatggatcatctcaaaattatgctgcacatgtttatgtgtatttgaacatcaagtcattcaggaatagtattaattctaaaaagggtaaatgttatcagagttttaagagaaattttggtattctctattaatttatttgtgaagatattctaggaaagatctgacaatcaattactgtactttttcatctcatctgattcttagatatgatctcaggcaaatattcaatagactattcattctattttactttatttgtatcaaatatgataagcatcaactatatatatattgaaatatgtttaagaagaattatagttctacataattatatacattcactttaatataataagcaaaaatgactcttgctgccaatagtattaggctcctatataggtatgaatgaacactgttctgaaacactgctgcacatggtactcaacaaatgataacaaatctatttggaatgtggaaaattttcttttcaaaagcagaaagtgaacaaggggaaatggaaatgaatagtatcagctattctggagaaataaaagtctgtaggttctagcagtagaattgtagggttaaaaacctgtatttctttctctttttatctcagtctctttccagacctcctaggttttattctctaatactaaatgttttctgcttttcttttttttttttttttgagacagagtcttgctgtgttgcccaggctggagtacagtggcatgatctcggctcacggtacgctccgcctcccgggttcatgccattcccctgcctcagcctccctagtagctgggactactggggcccgccaccacacccggctaattttttgtgtttttagtagagacggggtttcaccgtgttagccaggatggtctcgatctcctgaccttgtgatccgcctgccttggcctcccaaagtgctgggattacaggcgtgagccactgcgcccggcctgttttctgcttttcaactccaattcttgtgctttatgtttatcggatttctgcgatggataaaatatgatgatatatgatagatgacagagtagtagttggaaagagtccaggcctagaggcctatttcatttctgtttgcaacagctgaaaacttgtgtgctacaattgatatggcccctcctctttctgggccacttaaaacaacagctttgataacttgttctgagttaccttttattctatgtaattaacttagatgactttcttcctaatagaaggaagagcttcaggggcaatccaataaaaaggaaaattttcctaaattttcagacagtacaattactatgtaaaattgaggcaaatattttgttagctttttgcttttatcttctgtttccctttgtcatgtactagacaacattaggctggtgctcacaagttttcagactcctggtaaagatgatgaaagtccctgaaaaatgtttgcaaaatggtatcctctgatgtaagtctttacatttcaaggaacattcagaaatttcagggtgtatgtgattcaagacatgagaggtttggcagctcagtcctttcacattatttgaagggaccttaggaactggcttctagcaacaaatctttccttaactggtgtccctaggaagcaggactacctgagaggtgaccctgggacaagattggcagggggccatggcagtttcattcctggatgtttatgtgtacacaattttcactaccctgaatgctttttcttctcctgtatgatttcgccttgacttttaaggttcagatgaaatattttccccatgtaaacttggcagagttcttgtaattcacctaggttttatattctgcatctgtaaatagaagctaataatatccttttcactgaggattaaatgagacatgggattgaacccaggtctagctaactccaaagtcattgcacttaaacagtgtattaggccattcttgcattgctataaataaatacctgaacctgggtaatttataaagaaaagcggttttattgacttgcagttcagcaggttgtacaggaagcatagtggcttctgcttctggagaggcctcagaaagctttcaattgtggtggaaagcaaagggggagcgggttgtctcacatggcaggagcagaagcaagagagagagagcaagagggaaagtgcaacatacttttaaagaaccagtgtcatgagaactcaccatcatgagaacagcaccaagggagatggtgctaaactgttcatgagaaacatctccatgatccagtcacctcccaccaagtcccacctccaacattggagattacaattctacatgagattggggcagagacacagattcataacatataaaatataatgctcaagatattttaagcaactacccactttattttttcctagtctaccatttatatagcaaacattctttctaaagatacctttattatctgcattggtcttttgaccctaggcattcactaccttttattgataaatattattttttggtatggataatcaagcatttattgaaaaatatttattgaaccacatttatgtattaaacgtatgctagatcaggagatacaaagaataagaaatcgttcttatgaagggactgaaagacaatgtgacatggtcttgtaaaaagttacattgaattgtaaattgggatattacaatgaaacgtcgtatgtgtaggtctacagcttgaaactagggttttctgtttccaacagaatgttaagcttttgaaagcaggaaccagtcttctatttcattcaacttttcattatttttagcctagtgtcctgttcttagtaggtgttgggatttatccatatatttattgatttgctttagtaaaatagaagctctctattacatattagttacttgtagctgtataacacattaccccaaaatttagctgcttaaagcatcagagatttgttatttcacacaggttctgaggattaggaatctgagagtatctgaactggttggttctagctcagggtctctcatgagttgtaatcaagttgtcagctggaattgcagtcatctgaaggcttgactggagctggaggatctgcttccaagatggcttactcacatggcttttggcagaaaaccccagatgcttagcatgtgggcttctcaacagagctacctgaatattcttacatcatggcagctggcttcccccagagtaagtgactcacaaagaagagagaataagcaggaattgcaataccttttatggtctaatctctgaagttgtgcacatcacttctgctttattctattcattagaagtgagtcactaagtccagtacgcactcaaggggaggagaattaggctctacctcttaaaggagcagtaacaaataatttgtggatatatcttaaagttaccacagtacactaacagcacaaaatgtactctatcattattttctttttgagctctgtaggctgagggcaaaacttcagaaaataggaagatgaaggcagggaaaataaagagggactgggagaatgcacagggtagtttagagggaatgagggtctggcatagggcaaagaatctacacaacctgggaatgttatgttctgatgtcttaggtattcataagaagggggctaaagagaatgacagtgagagatggaagtggggaaagaatgaagaagaacaaaataactgagagaaaacaaggataattgtgtagaaagtgaaagggcaagagaagaaaataaaataaaatacctctaggaaaaaatctctggaatcagtcaaaagctgttgcccagttgtgaagcaaataagcccattggaactgtccaaaggggctattttctaaaatctttattgtatagtatctgagtataactgtttgagacatttttatggtgatttaggtgccaatgctgaaaagaatgaattaagattcaagagtagaacaatttataattattttaaagaaaatatatggagaaaaaaagataagaattggtagaagtttttttgtataaaagatttagaaataaagttgttatcagagacaataattatataactgaagagtcattgctgggcacattatgaacacatttaggctatgaaaagtgaaatataaatgtgtgatgaaaccaaggcaaggtggaattaaaattccatccttcctcattcccctcctaattacttagtggggagagagaaagtattgaagtcatttcatctttttcacatacagatatagagaaatttcattataatcttgtggcatgtttagatatcagagatacaacatgtggaactgacataacatacatgcaaactaagtggtcagatagatttactgctttagttgtgtaggtcaattacacaaagacaatttatatgaccaggatattatttagaaggaaaagagataagacccatgcaaataaactggcaagacctagttaagtatcaagagagacattgtagagtttagacaatgcagagttaataggaagaggagtatcttagaaacatcaataggagaaagaagcaattgatgaatggaattaggcatatgatttaacttggcagcaatggtccccatgagaagggagtgtccaaaataagtaaagttcaagggatgtaactagactgttaaaaagcagagtacagactttaaagatagtcagtggaggcccaaaatggggatttttgtcttactcttaagcattaactcacctaagagggaacaatgatgatgatcttttacataaaatatggaaaaataaaagactatcagctttgatattgacaggcacatttttcttcacatcagggggcctatttttggtctattttccaacatttaaatgaagaaagggttttctagtatttcttttggttataaacatagttttctgaattggaaaatttaggaaaatataaaagtgcataaaaataaattacaactatacaacccattgacaactgttaatattttagcacatttctatgttttgttttaatatttatgatttaaaagatttttttaaaaacagttttgcatactgcttactttactcagtatcatatcaggacaattttgtcattaaaaatctcttgtaaacatcattaaatttattaccttttaatttttgaataaattttaaggggcataagatagttaatcctaatatttactaaaacattataatacaaaatagaaaataaatgatacatgtttaaattattaatggttgaaactgttgactacgtactgtgataataacaggtaatactaattatttactctgccacaggaactgttctaagtactttgtatggattacatcatttaacaatcatattagccactatgaggaacctataattattattcccgttttacttaaagaggtttagtaatgtggctcaagttctcacagctagtaagtatggagctgaaatccaaacaaggcaatttgactcccaagtccatctttctaaatctatacattttgcattatatgtttaagccttgcattaggaactggagatagaatgataaggaaaccatagagggtctgctcttgctgagctgtagcgtgtagagaaacagttattaccaaataattaacattttaaatgtataattacaaactgaaatcagcacactaaatgaaaggaacatagatcgacaatagacaacaggagcctgactaagtgagtaaactagggaaggcttcctggaggaggtgacacaagctgacagctgaagaacgaacaacaatcagtgaggtaaaggggaaagatacattccagacagaaggaatagcatgcagaaaggccctagagtgagagggaacatgaatgttcagaaaactggaagaaattcagtgtgactggggctcacagattgtatgggagcaggctgtggcccaggaatgtagggcatgctgaggattttgaactttaaggacaatggaaatctcagagttttatgtaggtggtgacataatcagatttattttgaaaggatctttccatctgaagaatgacagacatactggagggaggctagagggaatgtggggtggatttctggtagacttttgctgaagtcgaataagaaatgaagataactcggtctaaggtagtggcaggaaaggtggaaagacctgaacatatttaagagatatttaacaggtaaatttgaaaatggtgatggagttagtatgttttctatgggctgagatagacaatactagaagaccaaaatttaggagggcagatcatgagttcaatcttggaaacagtgagtttgacatgtgaatattttgagtatgcagttgcgtactgagtgtggaaccagagtctttgccatagagatttaatcaatttgatgaatatgggtaaaaaaaaaaagaagaagataaagtgcaaagagaatgtagtgggctctggggagcactatttcatgactgggcaaagaattatgagttatcaaggaaaatttagttagaagagcatgttaactaggttggaattgttggcaacaactgagggtatactggaagttggtgatgatgaatttatggtgattcttgtctcccctgaggtgtgactctgcaaacagcaccacagaggcaaggaagcctggtggcaagaatgacccagaaaggttttgtaagatatgtgaaacgagaaggttgagtgtcagaggattcaggcatgagatagcataatttaccattcattttttttaaacatagaaaagggtttcttaaaaaaaaattgaggcttggcacgtgtctcacatacctgcaacctcagcactttcggaggtcgaattgggtgaatcgcttgagctcaggagttcgagacctgggcaatatggtgaaaccccatctctgccaaaaatacaaaaaattagctgggcatggtggcacatgcctgtagtcccagctacttgggaggctgaggtgggaggatagcttgagcccaggaggtggaggctacagtgagctgagatcgtaccactgcactccagcctgggtgacagagtaaaaccccacccactcatccccccaccccgaatttaaataattctgagaaataccttttatgcataaacatttgtctcttttaaatatttcttttggagaaattcctataagaattactcaaagagtaagaataactttcagccttttaaatgacattgccaatttgtttccagattcctctaatcttgtttgcatgggggcagtggctgttctaatttttattctttgtgttttgacaggctaaaagaatgtatccttcaaattcttctttcttactctctttcagctgctgtgtcatgagtaattttctttggttaaggtgcatatctcatgcacatgtgagaaggtcttcatgttgctttggaacaacaaagaaaaccttctggttattgaatctttgggtcataagcactttccctctcaaccactaaagatcttactccattttgttgtgatgttttatgatatggacaaaactgaggccaaattgttccaagaagagggaaatgcaaaggccccaaggtggagaatgcttgggaagaaagccagtgttaccacagtggagagagacaagagagaagtggagaaagagtgagagagcaggtactgggagatgaggccaaagagatagtgcagaatccaaatcataaccaagtcctgaaggcagggtgaggagtgtgcatttcattttgagtgagatgagaaaccactgggtggttgtaagagggggagtgaagtggtatgatttgcattgtaaagcaattgcatggttagggttggcacacacaggcagggtggaagtagaggcctcttcgggctactggttctcaggtagttcaagggcagaaatggggtctaaagcaggtatggggtggggactgtgcggtgacacaaataagccctcccagatcagttatttctatgctgatgtctaaatggaaaagcctgaagaggactctcccttcggctttaaggcctagggtacaaaaggcagggcagggcctgggcttgggggccttcatctgcttctccctgactagaatgaggaaggtctcagtgtctgtctgtctgtctgtctgtctctctctctctctatctgtgtgtgtgtgtgtgtgtttatagcctgggagtttagttatctatttctttccaggcttggctcttagcctcttttcttcacctccctctaaggatcttctcttgggagaagtattcagcagatactgaaggattatgactctaggtcactttctgactattttccctccctttcatgcagggtgtgtgagacatgggttcccagcacagatattttttctttcttatgttcaaatgatatcatcagcctaatttctccacaattctgattagatatcaaatttatcatacagtttcttgaatttcccattggtcacaaatagtattaatatcctttagagttactaattaaatctaatttttggatgccttagcccccacacttgaatcttttcccccctccttgaaacttgaccttaagcctatttagaaatcccagttctcactaaagagtaacgctatgaattttgagatgctttgaagaatgcacagggatttgtcataccctacttattggttctatttttgagtccatgtgaaatctcagcttcctccctcacccccagtttactttataaatgctcctgctaatctagcccccttctgatctccctcattgctttgggctagtctgaagcaacagaaggacttgctaaatttgtatattcttcctgagtcctggggctttgtgggaacaattataaaaatttaccaagtctggagaagaaggccttcgcaaatcttgagtgcgcagggagaagcgaatgtgtctggcgtttctgagaagatatttgtttattcataaatcatttattgaacatcagctctgtactaggcattgaattttgagcttgcattagtcacgtaagtcatagtgtttaaagagaccaaagcctgatagatgaagatagacttttcaacaatgattgtctcagagtatttataggtaatatgattaatttatataccaggcccaatgaggagacaaggaaacattcgatagaggctggagaagcttagaggggtgacattttagttttgaagagatgacccagttgtaggatgagttaaaagggtatggcatgagtcataactgtgagataagatacaggcctgtcatgagatctctaagtatctctgaaagcttaaaagggtaaagatggggcttactaggatatatggttggagagtcagccaaggagagccaagtatgacatatgagggctttggatttatcctatggacaaaagagagctttgaaaggttctaagcaaggttgttatatgaccaaattttcctttcagaaaaccatttcttcagcaaaattttgcgctgagatgaattcaagtaccattgcaacaactcacataagacaaaggcctccaatgaaggtggggtgggtagtgggtgtggccaggagtaggagaagattgtgtgggggtggtgaggaggtggatgggatggaggatggaaagagaggtttccaaaagttttaagaaggtagaattgacaggacatggtgagagacttgaagtgggtgatgagaaaaaggaaaaagcataatttaggggaaatatgaatttaggcttagaatttagaactttaggtgccaatggaacttccagttggagtggttcattggacagccaaatatttgagaccattactcaagaaggcagttgacacagacatcttagcctcaaagttccttgaatccttcactttaaggagcttcctcagtcttcacttcagcaaaccatatctacagtcaagtctagatcctgacatcaccttcacatgctctaaatttgaagaattaaggtctggtatggcaatgtgaccactggttccttgtatgttcaagctatcttattgctttatatccatatcttttcacttaatgactcaatgacatgaagtcactcaatgagtcattaagtcaaagtcattgagacttcatgtcttgccacatcttcttttctcctagtccatcagagttggtcttgttattccttcctgtaaccagtctagactgaaaaggagcagtcctgccctttaatatttagtacacacaacatgctcattcttttactttctgacatacttatgttgcagactctttatgttggatctgggaagctgaatgctaaagggaagcacattattgtacagacaggggccaccactaatatgtagattacagtggttccctcagcacttctgtataatatatttctgtccaggttcctttactgaaaactgtgggacatttcaaaccttcactgctttcttcctgtcttcattcatactgataccctgcctccaaactcaactgacatacggtcttattctctgcttcaaacagttgaagggactatgtctgactccttcaaccatccagtgtcttcagacttattcaggggttcacttaaatgccttttcctctggtcacaaaggagaagataattaaaagatgttaatattctaagatcattctgtgtccttcacttgcttatttctgttttacttattccttctttctcctttacattgatctctctgtattggttttttcttagaggactgtgagtttagtataaattatggaatgatatcctttaggacaaaaaaggaaagaatggtggttacatagaatgaagcacaaggaataacccttctcatttcagcacactgagtactgacttagagctgccattgggttcaactctaggttgtacccatgagattgttaacataggaactgaattaagaaagttagaatgtctgttttgagaccaggactcaaggtgataccaacatagacttgagctttgtattttatttaaacatctgcctatgttgtgtaagatttcctgtacttttgaaacctaatgacatgatatcccagatgtttaaaatcaattatttttaattcattgcatgcttgctacgtttcaaattctggtctcaaattatggaaatatctctaattttcctataaatgttgtgagatgcagtggtgtggagccacttcacccaggctcacaagagctaattttgcacatcccttcccaaactctgtgttcagtgacttgaatcagctatagcaggaggatttacactgtggaatcaacactcactgcaaattgaggctttttatttcttcatttcaaggacctggtttaccagcatactacttaagataggtcatatgtccccattttacagctgaaatttaggttcagagaaataactccctaaattaggttaactgtgaaagctacatgggtttttgggaggcaaggcaagatattctgtaagagagtaagacattgtcttttctcttcttttctcttcttattctcttcttaatcttttctttttctactgaagttgtagactgcaattggatttagactttctccatagaagtttatatatccttgtgaactgtatatcttccgtcttctgtttttttttttttttcccctcactctgttgcccaggctggagtgcagtggcacaatctcggctcagtgcaacctccacctctgggttcaaaggattctcttgcctcagcctcccgagtagctgggattatgggcatgtaccaccacacctggctaatttttgtatttttagtaatattttcttggtccctaataagttataatgtgaacattttgatgttcttttatttcttttactttcctcattaaacataaatggatcataagacagtctttgagatctagaggttggtgtatgttaggatgttattttttgttatgcttggttttctaataaatatatttgcaaaatgttcccaacactcaatttattaatgcttattctattactaaccagttctataaccctaaacaagttttcttagttgttcaggatggggatatgaccagtgacccctaaggtcatggccattcatgccaccattaaaattcttatgcttctgataagtagagtatgccccagtgtgcccctaaattactttatttaggacttaaatccacattagtatttactgtggatttttagtcctaaataaagtaatttcagtttaattttattaaaaatgtagctttagaggtagtttcattattttgttgtgcaataaggtttttattttgtttgaaaagtttcaggatctgaagctgagggaattctactgtgagggaaacccactgttcctgcagcagccagtgatttctacacagcaggagaacgtctggagtctacaggtgaagacttacctcattaacttaagtcttcaaactaaagccacaatttaaattttaaagcgttttcttttaaaacattcttgccaagccagcaaatgattaatgtaatcctagtccattggcaatgtggatcctatacataatctttttgacttgcttatagaatccagtgaaatcctaagtcactctgattcccagagtgacttaattcagagaaatggaaatattttgtaggatgaataaaagagagaaatttattttcactttagccttttcagtgttatttaaagatgtattgatttgttcttagtgtagtctttacctctttcactccctttttactcgtctctatccctagtggatgaatgaatatgatccagaaactgtgttcacttcagcaaaacaagttaatggtattaaaagaaggaacaggaaagcatattacagaactctttggtaatagacaagtcagagatcacaggtcctcccacatttggctatgattctccatcaagaatttagatttctgagatccatttgggtctgtagctaatgtgcaggattgtcataagacttttaggatttgtatgggatcaactttcctggctgcaggaaacatccagtcttgtccagtggcttactttgtttttttttttttaattaaattattgtatgaataatacctgtttattgcagaaaacaataacatacagatgagcaatggagaaaatcaaaatttcttatactgacttttaaaaagtttcttactacaaaagtaatacaagctcccgtagagaaattagggcaaaaaaaagccaatagaagttaataaaaatactaagaaatcaaattaatgctctatgacatttattcttttagaactttttatgcattcaaaatatttttgtaattaaagatgagttcaaactctatacactatatagagttgtttttccactcaattattgtgaatagctttccaatcagtaaaacaaaacaaaataaaaccagaccatgacatcttttttgatgaatacatggtattctgtatatgatgatatcataatatttttaactacttccccactgttggatgtttaaattattaataattttctggctttttagcctttataaacaaagatacaaggctgggcacagtgtctcatgcctgaggccccagcaatttgagaggtcatggcaggatgattgcttgagcccaggagtttgagaccagcctggccaacagagtgagaccccatctctacaaaattttaaaaaccttagccaggcatggcagtgtgtgcctgtggtctcagctactcaggaggcttgagcccagtaggttgagtctgcaatgagttgggttcatgctactgcactccagcctgggtgacagagcaggatcctgtctcaaacccccccccccccaagtcaaaaagcaacaacaacaaaaagcaaagggacagtgaccattctcatagtacatttttagttcctgtgcatattatccctaaaaatgtaactgctgggccaaagaactgacatcttgtaaagtttgatttatttttttcagattccctttcacagaatattttcacaaacagcattatttcttactcttctgtaacagaaaaacatctcatttgaaatttaatagtaaataatttgagtaacagttgtatttaattttttattcccttataacttattttttctcctttcatcaatcatttcagtataataatagcagctaacacttattttatgcctattatggacaaggtactgttctaagcacttaacaggaataaactaatttagtcctctactaaccctaaaaagataggtatcattattgaccactttttatagatatagaaatggagattcagggaggtcaaataacttatctgaggtcacagagctactaagtgttgggacaatgacgccaacttaagcagttgggttccagactcccagctgcaatattggttcagaaaggggatatagggagctgagggaaatggagacagggtcatcctgggttggaggaggttctggtttgtggaggaggctgaattagcagttaacccaatctggtagctgtcttacagagagccttcaaggacaagaaccttgtctgtgagggtggtgaatgagagagaaattgttctaattttcagaactgttgggtccaggagcacaaaagttaattttttttttcttttattattatacttaaagttttagggtacatgtgcacattgtgcaggttagttacatatgcacacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgaaaatgatgatttccaatttcatccatgtccctacaaaggacatgaactcatccttttttatgaatgcatagtattccatggtgtatatgtgccacattttctttatccagtctatcattgttggacatttgggttggttccaagtctttgctattgtgaatagtgctgcaataaacatacgtgtgcatgtgtctttacagcagcatgatttatagtcctttgggtacatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctattcatgtcctttgccgaatttttgatggggttgtttgtttttttcttgtaaatttgtttgagttctttgtagattctggatattagccctttgttagatgagtaggttgcaaaaattttctcccattttctaggttgcctgttcactctgatagtagtttcttttgctgtgcagaagctctttagtttaattagatcccatttgtcaattttggcttttgttgccattgcttttggtgttttagacatgaagtccttgcccaagcctatgtcctgaatggtattgcctaggttttcttctagggttttttacggttttagatctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggccatgcgggctcttttttggttccatatgaactttaaagtagttttttccaattctgtgaagaaaggcattggtagcttgatggggatggcattgaatctgtaaattaccttgggtagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagttatacaatcatgtcgtctgcaaacagggacaatttgacttcctcttttcctaattgaataccctttatttccttctcctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaaaggttgttgaattttgtcaaaggccttttctgcatctattgagataatcgtggtttttgtctttggctctgtttatatgctggattacatttattgatttgcgtatattgaaccagccttgcatcccagggatgaagcccacttgatcatgggggataagctttttgatgtgctgctggattcggtttgccagtattttattgaggatttttgcatcaatgttcatcaaggatattggtctaaaattctcttttttggttgtgtctctgccaggctttggtatcagaatgatgctggcctcataaaatgagttagggaggattctctattgttttattgattggaatagtttcagaaggaatggtaccagttcctccttgtacctctggtagaattcggctgtgaatccatctggtcctggactctttttggttagtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctttttttctttattagtcttgctagtggtctatctattttgttgatcctttcaaaaaaccagctcctggattcattaattttttgaagggttttttgtgtctgtatttccttcagttctgctctgattttagttatttcttgccttctgctagcttttgaatgtgtttgctcttgcttttctagttcttttaattgtgatgttagggtgtcaattttggatctttcctgctttgtcttgtgggcatttattgctataaatttccctctacacagtgctttgcatgtgtcccagagattctggtatgttgtgtctttgttctcattggtttcaaagaacatctttatttctgccttcattttgttatgtacccagtagtcattcaagagcaggttgttcagtttccatgtagttgagcggttttgagtgagattcttaatcctgagttctagtttgattgcactgtggtctgagagatagtttgttataatttctgttcttttacatttgctgaggagagctttacttccaagtgtgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtaggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaagtctgttttatcagagactaggattgcaacccctgcctttttctgttttccatttgcttggaagatcttcctgcatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcattagttgatgcagtttcttcctagtcctgatggtctttacattttggcatgattttgcagcggctggtaccagttgttcctttccatgtttagcgcttccttcaggagctcttttagggcaggccttgtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctcccgagagatctgctgttagtctgatgggcttccctttgagggtaacccgacctttctctctggctgcccttaacattttttccttcatttcaagtttggtgaatctgacaattatgtgtcttggagttgctcttctcgaggagtatctttgttgtgttctctgtatttcctgaatctgaacgttggcctgccttgctagattggggaagttctcctggataatatcctgcagagtgttttccaacttggttccattctccccatcactttcaggtacaccaagcagacgtagatttggtcttttcacatagtcccatatttcttggagggtttgctcatttctttttattcttttttctctaaacttcccttcttgcttcatttcattcatttcatcttccatcgctgataccctttcttccagttgatcgcatcagctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagcttgtcaaagttgttctccgtccagctttgttccattgctggtgaggcactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcggtgtgaggtgtcagtgtgcccctgctggggggtgcctcccagttaggctactcgggggtcaggggtcagggacccacttgaggaggcagtccgcccattctcagatctccagccgcgtgctgggagaaccactgctctcttcaaagctgtcagacagggacatttaagtctgcagaggttactgctgtctttttgtttgtctgtgccctgcccccagaggtggagcctacagaggcaggcaggcctcctggagctgtggtgggctccacccagttcgagcttccccggctgctttgtttacctaatcaagcctggccaatggcgggcgcccctcccccagcctcgctgccgcctcgcagtttgatctcagactgctgtgctagcaatcagcgagactccgtgggcgtaggaccctccgagccaggtgcgggatattatctcgtggtgcgccgttttttaagcccgtcggaaaagcgcagtattagggtgggagtgacccgattttccagatgccgtccgacacccctttctttgactaggaaagggaactccctgaccccttgcgcttcccgagtgaggcaatgcctcaccctgcttcggctcgcgcacggtgcgcgcacccactgaccggcgcccactgtctggcactccctagtgagatgaacccggtacctcagatggaaatgcagaaatcacccgtcttctgtgtcgctcacggtgggagctgtagactggagctgttcctattcggccatcttggctcctcccgtctccaaaagttaatttttacaatgtgtttagtggaagtagctatctatgcctgtaatatgtaaatgatgtgtgtagttttaagagtatccctaagaattcttctcagaaaagtgacttaaattgatttgtacttaaagtaagagttatttctactgggcatttagtcaatgttactgattaaagtacttgctgtgtcaaagaattctaggaactatgatatgggttatgccttggtaaagattttagaaactttacctcacctcagagatttatgaagtaaaatttattgctaataactatattatagaaaaatattagcgggaatatactgcattagtagatgccaggctaaatggtttaccgtttttatgtaatttaattctccaaactctttgtgatagtattggaaaaaaatcccaactttacagatgaggtgttcaagaccagggaagttaagggttcatccaaatatgaccacacagcaaataagtcatagagccagaatttacacctatgcatgtatttgtctcagactttgaatttttgctcttgatgctacgttttagtgcttatcatacacatagtaacacctgagtatacaatagttccaaaatgtatcactcctaaggattcatatttgtttttacattttatgtttttcatattatataatttttatgtgtataatttaataactcaaaaattataaggaaaatgtaggacatataaaatcaatttcatttatgatgaattataattaacttacaaatattctaagaaaatagcatataagctatctaaaaggagcaatttgagtattttgaaatatttttatagaccactttggtctataaaagatttcttgacttttaaataacactggaattagaccatcattaaattgtatactctcaaaaattgcactgaatgcatctctaagagatgtcctaaaagatactattggtcatgccaatagtattttattttatatatactcacatttccaagtaagaactttatattttaatggtgtatgctatccttccaaaataacacattggcaataagtaaaagaaaaatataaataatagttgatgtaagagctgtcagatatactgagtgcaacaaacatgtttgggtccagaaatcataaatggaaaaagtgatctatatgaacctatttttaggtccctggtatttcagcaaatgcttctgtcatctgctattttgggtagtgaatccttatccatgagttttctacagctttataataagacttggccattgaattcgtgtagctaaaagcccacctataaaatcagtatttatttaagaatcacaagctatgatctgcttaagtagttggagaaagggtgaaaataaacatctgatttaggcacccttgtaatattagtgtgaaagcatgacctcagtcatgcaaccacccaggagaatgagcttaagtgggtaggaggttgtgctgttgaacgatcagacaaataaagaatccatgctcagggctgtttactgtataaaggcagctttctcgggtgcttgtttattgggagggataggataataggaaatggacacagcaatttataagattttgctgttattttttaagtttttaaataatttaatttctttaaaattaaattaatttcatgcatggggagaatgcatgaaagattatgtgtgtatatatgtattttcaaaaattcctatccaagctttatgtggactatttcaatactactgggaaatctttcacttttgttgggaaaaaaaagtaccaaataaatcatccccaaacactgttaaaatttcaagcagtgtttgtgtaacatttatacaggacttccatgctactgacaaaaacaatggagaaaatttaatggattcaggcaaatgtttatttattttctttgcttggtcagtgaagatttaattttatgcattatgtaatatatttttattaagatgatagccctaatgaaaggcaacttccattttcttacttcctccctttattatttagtattttattattattattgcaagtcaattttctgaacatatctaggtagataggtttaactgagattaaattcacatatttggttcctagaaatcattgcttttttgatggcactattcaggttctcagtgcagcaaggaatttagaccagtgcttctcaaatttcaatatgcgtatagattacctgaggaactagttaaattgcagattttgattcagtaggtctggagtgtgtctgacattctgcatatctaataagctcccatgtgatgcagtctgtgaaccacagttcaagtagttaggatttagaccttagtgaacatgacaaaattcatttttgaatccagtctgaatgtttgtacagtttttgcttattgtaatgagaggtgccagatttaaacctaaactgtatctaactttataaaatgtgtaatgcaaatgtattacgacttggattcctatatgtaagagatgtagaaatacgacaatgtaagaaacttattgttcttatattgatgaaaaccaaacttatttgcaatgccagtcatttacaacacaattcattagatacactgcagaatcttaatttaacagaatctagataataagccatacactttatctaatgaaatggaaatcaatgtaatgtaaaatagttttgaaaacaatctgaggaactgtattttttttttcaatttaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggtaaatgatgctttttatgcgaatatgagcataatactgattcctatcctttgttcttatctaaatcagttaatactaactagatttgtacctatgattggcttataggatagtatactgtaaattttggatagacaaatttggataagtgtcggtaataatcatcatcacccattctatttacattcatagactcccaaatttatcaaaatacatggattctagcaaaatttcatgaaagttgaaagtttttaatcagtaaatcccttttgttcatgaatattaataataaaaccagaactaaattcttctcagaagaagaattggtcagtagtctgtcatggaattcttggtgtagaaaaggtgaatgtgctggctagtttatatcatgatggtgttctagaacactaaatacgcatgaatgtgcacctgcaacattatgttacccaggagttgtgaatcccagggcagttcacatagcccataaggcgtgttctagaccagagctcagcaaactcctttttctctaagcggccagatagtaaatattttaggccttatagacagtgtgatctgtgtgactactacttgactctcctttgtagcatgaatgcagctctagataatatgtacatgagtgtagctgtgttctaataaaactttacttgtgaatttaaatttcatataatgttaacatatcatgaaatattattttattttgatttttttttcaaccatttaaaaatgtgaaaacctttcttagcttacaagtcttatgaaaacaggaggtgggtcaaatttggcctggggaccatagttttcccacacttgttctagactgtctaatgtttgcttttaataccagaattcctttctgctcttggtgagcccttggccttccttgggctagcatagtataatattgggggataattttaaataaattaataaaaacagctgcagtttctgccattctgaaaattgtcatctagtgaaggagacaaacaaataagtaaacacaaatgtaacataaattgtgactaacatgacataaaagaatggtatattagtttgctagggctgacctaacgaagtactacaaactaggtggcttaaaacaagagaaatttaggctgggtgcggtggctcacacctgtaatcccagcactttgtgaagtcgaggtgggtggatcacctgaggtcaggagtttgagaccagtctggccaatatgataaaatcacatctctactaaaaatacaaaaattacctgggtgtggtgatgggcgcctgtaatcccagcttcttgggagactgagacaggagaatcacttgaatctgggaggcagaggttgtagttaaccgagattgcaccactgcactccagcctaggcaacagagcgagactctgtctaaaacaaaaacaaaaacaaaaacaaaaacacaacaaacaaacaaacaaaagaaaacaagagaaatgtattgtctcacagttgtagaggctagaagtttaaaatcaggtgtcatttaatttgatcatcttggtaaaggccctatttccaaacaaggtgacttttgggggcactggatgttaggacttcaacatatgaattttggcagaaacacaattcagcccataaccaatgggtttcacaaggaagagtatcagggaagcccttctttaaatctgggataagggaagtcttcacagaggaaatgatattttaaatgacacctcaaaggtaaagaaggtcaggtagaattgtggaagagtgtttccaggaaactgttccagtaggaacagtgtgtattaatgggaaatcactttttgattcgaggaactgaaaaatggttcagtgtgattagaaagtattaattgactaggagagttgagataggcaggagtgagatcacaaaataccacgtagtttacattaggaatttggcttctatttaatatgtgatgagacacatttgaggaattttaagtaaaagagtggtatatcctaatttacattttaacaatataacatctgcatagagaatgaattagagggcaaggaagtgagattaggcagtaggctatttgcactagaccagctgagagatgatgatcgcagtggcaatggagggaaattatggattgaagatgcatcttggagaaagaagtgataagacttagatttccaggtttttttggcctacagaactgtgtaaagcagattttttttttattactaaaatagggaagactaagggagaagtaggcttgttggggagagatagaagttctgtttttgcacatggttaagtatgagactcctgcaaaatctgggagcctgagcaacctggaagctatagactcctatctagtctgttaggcatgctgggaagtctaggactcattgttagctgtgagtgtgtgtgtgggtgggtgggaagattttggtagggaactagatatgtgacctctaacatcatctctatctctaaagagtttgattctaaatcctgttgttcaagtgatttagggtatcattatgctccagtagtctttgtgccaataaaggatctgagttgtgaatatgcttatacctatctttttttttttttctttccgagacaaagtctggctctgtcacccagcctaaagtgcagtggtggtgatcttggttcactgcaacctccatctcctgtgttcaagcaattctcctgcctcggcctctcaagtagctgggattacaggtggccaccaccacacctggcttttttttgtgtgtgtatttttagtagagatggggttttaccatgttggccaggcttgtctcgaactcctgatctcaggtgatctgcctgccttggcctcccaaagtgctgggattacaagcgtaagccactgcgcccagcctcagtgtatcttatcactagccactcaccaaatttaccaaagaatcttttaaaaaatacagattatcctaccctagaactactaaatcagagtctgtagcagtaggatcctgagcatccacatttttatgaagatttctagccgggcacggtggctcacgcctgtaatcccagcactttcggaggctgaggcgggcagatcacgaggtcaggagatcgagaccatcctggctaacacagtgaaaccccgtctctactaaaaaaaatacaaaaaattagccgggtgtggtggcgggcacctatagtcccagctacttgggatgctgaggcaggaaaatggtgtgaacccaggaggagcagcttgcagtgagccgagatcgtgccactgcactccagcctgggcaacagagaaagactccatctcaaaaaaaaaaaaaaaaaaaagatttctagttgattttcatgtgcagtcagggctgagaatctctgctctccctgtttagggctgtcccagtaccacagggaaatggttgtgtcttacacaccttactaagcaaggcctatgtggtttctcacacataacaaaaagttgaatataaaaaaagttgaatgaatattcattggttgaatatatgaattaatgaattgttagtgacaaaggtgtagtacagctaatagtgaaaaaagaaaaggaggtgttggtgaaggagtaaatccactgtggagcactggaagatgacaaacaccttaatatggcctctatgctggggagaattcttactatggctgccttcaggcacactgtagagtttgctctgtcagtctgcttcttggaccctatgctgaaagtctttcactttactccactgtaagcagaacaaaggctcctgcatacaagtatgctatgttcccaaggatctccagagcctggattaggcctttcgcctttcacagcccatggcctccccagggacaatcgatgagtgcatgtgaatgctgataatgtattcttactagcattattagttgtttcataagcttacatttctaactcctggatgagatcatcactacttaggttcagagatacattatctttctcaaaactgtaattgtgaaactttctttcatgaacttcactatatgtgttgttcatcatgaggttcaacaaggacaactttttttccaccaactttttagtttgagaaattggaaaacaacacataacttgaatgaataatacaatgaacatttgtataccctttacctagagttgccgatttttaatatttttttccattggccttatctgttactgttttttgcctttcaggatgcatcttgtccaaaacaaatttgatattgacacaagccaagaatgtagcctacctagaaagattgtattattacttttcagggcaaaaatagaagaatagattcgaattataaaaaatatgaatgaatgaatgaatggataaataaagctatccttcataccaagtagagagattttatcaagagttacagtggataacacaatatatgagccagaaaatatgtaggttattttagctatactaacccacgcttaggacatggaggctcacgttactggcctgtttactttccaagaagcagagtacagattttacaacagctgctttacgtagttcatttataatcctgtagaatgaaatccaggaacagtcatcagagttcacatcacctgatgtcaggtatttacacatcacctgatgccaggtattcacgtcacctgatatcaggtatttactctgaactagctctgtggatcctgacagacagcctgatagacaggatccacagagctagtccagagtaaaagacctaaatcagctgtggttgtggtgtagagctactacaatttttctcacaatgtcctttaccagagtttttgacactgccaagtattgtaaaatgttgcatgtgaattgggagactaaaaggaaggctagaagtgttttcctcttgatccagtcatgtacaaattatgtcttactagacataaccatgtgtgcttaagacaaaaaaataaaagtggaagaatctaatcagagaaatcattctcatctcagttacatgtatattgggctttagtgtagtggttgcctataaaagttctctatgaataagaaacagtgatttaagttgttcagtttttcaataccttgatgctcttgctatggaaatgtctttgtcaaagttgagttggtgtttatatcagaaagctttgaagtcttcatggcatttagcaaaatttgtagtaatcgatttacttggtgttggtgtctgtctctaccactgaatactaagctcaaggaatttaagaaccattttggttttgttcacctttatagagagagagcttcggacaatacctgataaaattttatttctacagaatgataaatcagatctggatttgaataccagctcctcctttaattagtttgtcaacatattacatctctatgtatcataagaaaaatctggcaaaggtgctgccaaggaaggctaatgttaaaatttttaaaagcccagaatctagaactaaacagatagccaaagagaacattaaaatagtggttgagcaggaatttgaaagttaaaaccagctggaccttaaatacaaagagaaaagacagctcatcggtgggaaaatgaggatagaaatgtatgttggtcctcaagatgggagtaaatatgtaatcttgatcacatatgtagctatctgtgaattgttcacattatcatctggaatggattgttatattcaagagacatttaatgagtacagcgtgtcagattactcggaaacagttttcaaaacatcctgctttccactggtgatgttctgaacaccttagacaagttgccatgtttaattgtgctctgacagattccctctcaaaaccatctgatgtgctgctactcttatttcatgtctctctttcagaaactacaacctaatacaagcaacaacagccagaatttatttggtactgagtgtgcatctggtgctctgctaaatatgtcacctggaatacctcaattaatgtccaaaataaccccatgacaccagtaagaaatccaaggcaaggagaaaccaagtaattttgccaatttcagaaagctgccaagtagaggatatgggcagggaactcatacatgttattcctgatccttaaccagagagtctgggctatgtttcctatgcttttccaacctagttattccccatttacttcagctgaacttaagacatttatgttaaagatccttcttctgtcctcatttatttatccactgaaacttatttatttttttctaactgtgtgtcagattatttgccagggctgggaatacagaaccctgatccttgagaaactcacatgttcccaggagaagtgggataataaggattggaatctgacaagttaggtttgatgtccagccctaccacttgccacctgtgtcctgttacttccctcttcaaggctaagcttcctcatcctgtcaaatggcaataataataatacccatcacacagaactgtggctagggatcatgaggtaatgcataaacagtgcttagtacagtgggtgttcaacaaaggtagcatatagtaggtgcttaataagtatttttttttatgtgtgtgttttgtaaaccaaggctttcagacaagaaagagagaatgattgcattcttgtgataagcagatgtgaagctgcacaggatgctgtgagaagaaggcatctccagtaaatgggatagtccctggtttaaccctggtgcctaccacagtgattgtgtttggcgaatccataataaatgttaagttactttaagaggcatttcttagaaatgtgctttgaaggctagggaggcatttagaatagataaagaactagtggataagcatttcaggctaggcagttgcctgtgcagagttaatattgtgcaaatataaattgcacaatgtgtacagtgaagtcacggaaggtgaggtatgagagatgaagttggagaaaacagcagtgtgggttacagtgactcttttatgtgaagtttgagcttaatttcaaaagctagtgtataagttgctagggctgtataacaaagtatcacagactgggtggcttacacaacaggaattgatttattaacaattctggaggctagaagtctgagagcaaggtgccaggaggggttggcttctcctgcagcctctcttttcggcctctacatggctggctctttcctgtgtcttcacatggtcttcctttggtacatgtctgtgtccaaatttcctcttctcataaggatgtcagtcatattggattagagctcactttatttgacttcattttaacctaagtaacactttaaagaccctatctccaaatacagtgacattcggagatactggggtttaagacatatggatttttgggtgacacagtttagcccgtaacagctacttagagttgttgaagtagtggggtatgatgacatttttgcttgacaaagagaggctagacctggtgatgtggatttaaaaattgtttatataagtgagacactcgaagccctgggaatgaagattacctaaggagatctactcagtagggtgagaagaccagaaggacagaaccttggagggcaatattattaaaaggtggcaaaagcaggagtcagcaaatgagaatgaaaagaaacattcagggacagaagggcaaaacagggagagtggcacaaattcttcagctataaaacacagatgcacaataaacagggctttcttgctttttcttccactgaacttagcttttatttgggccccattctactggaaagtttacctagttaattcaaggcttatgtggtaattttaggatttcctaagtcatttcagattttatcttgatcacttagaatttccttcccttcctttctgcctatattatctaattcttggagtttttaagtagtgtcatggtattaggaggtaggagccatatgttctgccaatgtcctgtttcatgtgggcatcctctggtgtgtgatcttcctatctagatcgaagctccgtggtagtgtctacttcccattggtcatgcttcttcttccatgtaccctgtgtcttcttgttctgatgttgaagtcccttttgtttgctggttctctttcaaccacttctacactattctctgggcataagaaaattttggctgctctcttactctaatatgggctcaagaatgagctgactaaagacaccaagttgacagatccagggctgaggagaagaaacagcactgaaaaatcaaaagaggaaggtggtgtcctttgtgtcattaagtggcagggctggaagcaggttgcatcgataagaagcctgatggggccaggcgtggtggctcatgcctgtaatcccagcattctgcgaggccgaggcgggcggatcacctgaggtcaggaatttgagaccagcctgaccaacatggtgaaacctcgtctctactaaaaacacaaaaaaattagccagacatggtggtgggcacctgtaatcccagctactcgggagactgaggaggcaggagaagcacttgaagccagcaggcagaggttgtagtgagccgagatcacgccattgcacttgcactgcagcctggcaacaagagtgaaactatgtctcaataaataaataaataaataaataaataaataaaaaagcctggtaagaatacggaagtgaagccagcaagtcttgactaatctccaagcaatgtagctgtaaaaggtaggagtgctatagaatattctttggacgtgaggaaggcttgaagaaaaattttgaaaatgggaagatatgtgcatggttgtaggctgtggaaagagctagtaaggaggatgtaaaattagtctgtcttgtacaccaattcaggaagagtttaatgctgtgattaggtactgctactttaaaaaattagtagaatttttaatagaattttgttactgcatgatgaaccttatctattccatcatgttaagggaatgagtaagccaagaagaggagatatgaaaggttttaaacaactagaagatgggtaatggtagtgcttttccacttacaaaatgctttttacatatttttttctttcaacatctttactgagttcttactatatgcaaggtactatgctaagctctctggatccaaagatgaataagatgcagttcatgctattgaggagatcacagactattaaaatgtaacgttagaagcattgtcataaagcattatatacccatactatggagtcatagacagaaccaacaacgactttggtggaggctaaaaggtaaatttcccagggggtgacatttaagtaatagagtttctggccctcatattaactttgtgacttggttttcattgtctctattcacagttgaggtaactaagactaagcaaagttaagtagtttgttcacaaatttcaaatctatcaaataatagaattaggactttagcttacctgacacctcctgataccaccttctgtctcttttttcctgcactagaacatgcacaatttcattttgaatcataagagaaagtgcaaataaatttattgattgatgatgataccattactcccaatagctatctttgtatatttgaaacactgtcatgtgaaagagagatgaggctttccttctgttgacttgcagagtaagaaaatagaaccactgaccattcaggtcagatagatagaactttcttacaggattttaaacacagacacacacacacacagacacacacacacacacacacacacacacacacaggttaacatcaatcatcactgaggaaacaagcttggaagcaagagtaggaaaataaggagatttgatatctatataatttcactttaaaaattaaaagagaatacatttttatgaattaaatatgtcagggcattataaaaacagcaacataatggcataagaatatagcatggattaaaaacataatggttaaaagagaaacccattagctaggatctacaccctttgaatgttctagctaatggcagaaaatgttcaaatattgaaagaagacaatttcagattgaaaaagcacattgagttccaagcagaacaaacaagaacaaatccatacatagacacattttggtaaaactatataccaccaaagttgaactattgagagctaaagatgaaatgttaagaaaagagagatcacctacaaagcagcagcaatgaactgacatcagatttctcagtgacagtaatagatgccagaaaaaacaatggcatactattttcaaagcactaagggaaaataactcaaaatgtagacttatatgtgtagatacattgataggcaaaagccatgggagtgtcagaaaattataagaagaaaaaatttttaaaggaaaattgttttgctttataaaaaccatggattctagcgttattaaaatcattaagctaataatatctagtaagtatatgatagtaaaaaagtatatcacaatggaattagaataagtgtatacagcttgttaatcatgctaaataaatttaaggatgcttaaaatatttaaagattgataaagaaaattgagatttgaatatatattactagatgttagcagttaaaaaaaatttaaatgccgttcataagttccttgtttccagagttgaaacagagtgaaaacatgcacagaatacttggggatgataatcagattaaccacactggtaaggaattgcttttatatatctctagatttttatgttaagtagacagcaattatacaaatatatatatatatatatatattttttttttattttttttgcttggaagcctctctttctgttaaattttttttaatttgttaattatctcttcagaaactaaacttagagactgctgacctttagagcaaatactttatcaggaagggagaacatatttgataatgccaaagtctagttgcccctgttgtgctttacacaatgttctgcttcttatggggtttacactcaaaggagggagacactggatgataaatgggtctttattctcaacataaaacacagaacaatcaaatatcaagttgtaattgcttctattcaggtgaatgtaaaattatgtcatgcttgctttaatgaaataatgagatgaggattggaaaatagtcaaaacaattttattcagtctcaaatatcaatcttgatcataattaatccagatgcttttgtctttttctaaatgctatagttctgccatcaaagttgaattagtccttagcaattacaaaatgatcaataatttcaatgtagttgatatttcaatattagctactaatgatataaatctttgaaacagcaacacaaattatcctttttagttactactaactttgtctgtatttgaacaatgacttagacctaacctaaatagtctcataaaattctttccaaacacttgagtgatcctgtgcccaagatatgcatttaatagttttcatttcttatagtttcgttagttgaacttaacatttccccagattcctttaaagttgaatagtttagggagggaatggtttggaacatgaactctcaaccctgtattaaatgatgtaatgtaattaaaactaccctcaaaagagattagactgcgtaggtctccctataaatgagtgaaaacgttcatttactttatgaaaataaatgaaaatttgtaactttaattccttttttatgacaagctgccagtaatgaaacataagattacatttaataattttactcattacttataaagtaaaatcttactttgtagtaaaaagttattactgttaagataccactgacattcatttatgaaactgatcatttcaaccagtcaactgtgaaaatgaatgtaggttttaaaacatttatgccgtggttagtcaatttaatgtacattaggtactaagaggatcagaaagcatcacatttctaattctaaacagccatgaaagtcataagtatttatttagaaatattaaaatggatatatatttcttattgttttattccaaaaataacaaaacaattagagtataaacatgagctcatacactgtgtcttgattacttttactcctgtgagaactcctcgaatactcttaccctttcggagaactctcccttttgttctcaaactgctggatacagtcacagtagtattctgtatctataattttttttcttctaaataatcttacattttattgagctttagtttagttttctgaagctgtgtatcatcaaaatgttgaaaattccttgtgaaattcagaggatattgattatgcagggggtgctgtgggagagcaggaccactgtgtggggaagggaatgctgcttagctgggtggctggctggaacatgatgggattttctttgtcgtttctgttcttatcacagtccaaattgccctaagggtggaatgaccatataatgtgtcgtctaagccaagatgcttttgagagtaaaagtggattttattaatagctgtaaaaacaacaggaaaccaggactgtccttggcaaatcccaatgtatggttacccttgctaaatggagtagttaacttcagagcagtactcatgtcacttatcactgtggcatggcagtgataaattatatttagtcattccataaatttttgagggcctgctttaagcagggaactgaatgctaagtacaatgcgaataagtaggagacctagtctgttccaaatggtttaaaatttgagtttaaatgctaaagaggtaaaagatattagcaataaaatctagatattaaatgagtgatagagaccaattgctttaggattcaaagtggaagatgagatcactgtaggttgtctggtttgggaagtgcctagaaacacaggacttgtatatagccttgaaataggtggaattcagatacatggagaagaaagtaaacagaatgttttaggagaagagaatggtaaggaggagaataaatcatgttcatagggcagtgaatcagttaggttggtttgtggataggagtggcaggaggagacattattaaaaagttgaggtcacatgccatgaacctgtcaaaggattagattaagtaaggggtttgaacttgatcttgtttggaaatgaaaccctactgaacatgtgggggaaaaccggtgagatatatatgtgttcgtgtgtgtgtgttttagaaagagtcacttggcaatagtgtgctggcttagttgaagtttgaagagaagagaagctgaagataagaggctagttagagtggtttcctactgtgggtgtaaggtgtggtggtggaaaagcaaggaaagtatcataaggaaggaaggacaatataaattgttgattgattgagcatgggaaacctctgaggggtgtgaaggagaaagagtccagaagggagctggtttgggaggcaagaccccaagttgtatcttagacatgttgagtttcaagtgatgcctggataattcaagtgaatacgtttaaccctcagttggagacagactggcatggaaaagaaatatacttcttcagtatgttatttgaaaacatgtgcactttccaacaactgttcattcttctaaaccattctgtagttgctattaagctataatagaaaccctcattaatgaaagagcctgggaatcatacaatgactaacactaagctataatttagtgaacttagattctaatcttgtctctaccttgaaatatgaggcctaaggtaagtcatctaccttactatatcaggactaatttcctcatttggacaatgaagggattagaccagtctcttctagcatgaaaatgcattgattccataagcagggagggctgccattgttatgcttttcaagtcctgctaatttggaacatgataacagtattagttttccattgaagctgttaacaaatttcccaaagcttggtgacttgacagaaattttttttttttttttacagtcaagtagatcagaaattcaacatgggtctcactgggcaaaaatcaagattttgcaggctgggtttccatctggaggctcctggggggaaccattttctggcccttgacagcttctagaggctccccatatccattggctcatggttcctttcttccatcttcaaagtcagtattggctgatctaggccttctcatatcacctcacttggaccttctcttttatctccttcttccactttaacaactcttgtgattacatggcgcccacctaggtagtccagggtaacttccttatctcaaggtccttaatttaacccaacttgcaatgtcccttttgctatgtgaggtgacatgcatattcatgaatttcaggaattaggatgtggacatctttggggggacattattttgcctactgagatacattttcctgagaaaacaggaaaccatcttatgctctttttctattccttgtgcttcatataatattgaaatcttatccaaactttttactgtgccatataaatatatattgcaataatttttaatttctcaaagtttaaaatatggcagtgatggttaccaattatgttgaatgatttttaaaaatttctcaattctaccattcaacaaacataaaacttagcaaagagtaatatttgaatttaaagtggaaaactactttttaaaaaacacgtagagaatataatcatgtgtttgtttgctttagaaaataatgcaaatattaatggtgaaaaagtaaactgtattatagcattttactttttaaagctttttgctaaaatgatattttttcaaaataaaagcatatataatcacagaccaactccttttcctattcactgaccttggcttgacagaaaggatatttcattgagtgctttgatctctatctataaacaatgacaaaagcagtatttgtctttgacaaaatcatgaggttttgttaattgaggtttgtgaagagaggtcctctataacagggagtgtcttattcctttgtaacatgctcatttcaaatggacatatgtcgtaccagtagaaacagttgcaataatgccacaaatagaaatacaaatttaaaagggcagcaagtgttaaggtggtacgagaatttcatgttatgcaaacattactagagatgatgaatctagatggaaaagtgtaataccaagaaattatgctgagttgtttttctaagttaaatttctagaaaacaattcatagccctgaaaaatattgtataagaaatagaaattattaagttggagaataatcaccttcaaagtttcatgttcactataaaactaacaacgggcatttaatagacttctaaaaatctcaccaaaatattcattttattataattaactaaacaatgtttcccccaagaaggggaaagagggacacagacactttgcattcctgcttgcaataagagccaacctaaactctgcccatgcgatgtcctaatgacacaagggaaatggctaaaaccacactggaaatagaaaatgcctttaatactttctattataaacttttcacctcatgaagaaactggacaaagcaaatcagatgtcgaacttgtttccttagtttatatttgtttctttctctaacttcctcctcttggttcttggctctattaattgttcaggtttcttaaagaggagctgaggaaaatgtatgtagcatgttttattttcaatagttctttaattctagctgagatatgttacagaagtaggcaggattaactggttgggtgagacggttgtctagtatatggaaaaggaaaagaccatatttagcctgtcttttgccatttgttctccaaccacaatttcatcacttaatcattataatctagttagggaatcaatattatatcttatatagtagatttaaaatattatatgtgtctgtcattcaaaaatacttatgaaatctttttatttctggactaatgtattgttgatatcccatgatttaacattttatggtctatttatagtttatactgtattgtttccccaatacaatgtgcacattcttgaatttatgctctcatagttcaccctccccgaaatgtccttttggtttctccccaggcagacacattctagtcaaccttcaaaacccagctcacctttttcttatattgtgaaatcttgcttaatatgcagcctatggtgtctcctgtctctgcactcatatagaacctatccttgggctgagccatatgtttctatttgtgtgtgtgtgtatgattattgtctttccaactagatgctaagattcttagaggcagggattgtttgctgtatatctttgtagcctgacactttgcctaatgtgcagattttaggtaacttataatttgtcaggactcgtggttgcaaattaaagaaacccaactcatataccaacttaagcaatgaagaaggtccagggatgaatctggctgaagattttgtcatgtctaaattaggtttccaaatttatcattaggaatctgtcctttatttattatctctgcattcctttgttttggctttgttttccagtggctgctgcctaaattgtgtcttttgggagtaaagggagagcttccttctcccaatagatgcagagaatgtcctggggctgatgttcattggcttccttgaactgtcttgccttatgtgcttaccccagactaatcaccattgtcagagggaagcaattgagtcattgcctgggccgcagttacatggtcatatattgagccagggagtgagaaaagttgctctctcactcccccagcatatgcactgagattggaggagtggtagttgcccaaaggaaaaacagggcttttgtgccagcacaatgggaaatggatcccagacaggaaaaaccaagacgtccactgaggagttcagaacctgtttgctgattgatgaattaatatctttgtaggaaaaaagtcaggtttgtagatattctataccatttttcaccttcatccaaaatattttacagttaggatagtgctgtgtatcctctaagtgcttcacagccactgttggaggtctgtgtgaaggggatgtgacttatgactttggctccctgctgatacatcaccagggttagaaggctgttactctctcaagggtggatcaataactgtgcttacctgtctgaacctttcaataggatctcagagttcttttgtggaagagtgaacagaacagcaatcaaatctctcattgtgggttgtgatggtgttggccaaatggtttcatggtaaaactaagcagcgttatcaaccaattaaatatttcccagttaccagttgtggaaatcttttggattctctcactgagagctgtgttgatttcaggacatgattataaaacatagaaatggtaagcttttgaggttaccattatttcaaacataaatggtcaatatatgtgcactaaattggctaacaggattttgactgcttattttgtacaaattattttgaagtacaaaaatttaattcatgtattaggcaacttgcctgagacccagccagtgaagatcttaatgaatagtacagacagtgaacaaagaattttaggaagattaatttccatggcaactgcatgctgggcaggtaaaaccaagatacccattaagaagttcagtacgtatttgctgattgatcaatttaatacccctgaaggacaaaagtcaggttcatgtagattctgtatcattttttcaccttcatttcaaacactttatggttagactacataatgatatgtttgaataaaagcacacataatctttcatcatttggattttgtttagcatttgagtatgattttcttagctagttaagtttgtgtttttatgtgtgagaaaagagcaaatcaagcataaatagaatagtgcgtctttagaagtcaatgttctgaaacctctgagaaagcaaatatttattttaatgaaaaatacttattgaacactgcctaaattttatttttaatctttactttttaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaataattccattataacgttcccaatctaagcactacaatctgccttcagcttgcttagattctaggtgtgctttttttggcttaaaaaagtacaaaaaaaaattgaaaaat
